United States Patent
Marquez et al.

(10) Patent No.: US 11,661,567 B2
(45) Date of Patent: May 30, 2023

(54) PROTEASE VARIANTS AND USES THEREOF

(71) Applicant: DANISCO US INC., Palo Alto, CA (US)

(72) Inventors: David Marquez, San Jose, CA (US); Michael Stoner, Palo Alto, CA (US); James T. Kellis, Jr., Woodside, CA (US); Adam Garske, Palo Alto, CA (US); Joshua Roy Basler, Palo Alto, CA (US); Katherine Augustyn, San Francisco, CA (US); Priyanka Chandrasekaran, Brisbane, CA (US); Miles Christopher Scotcher, San Ramon, CA (US); Lilia Maria Babe, Emerald Hills, CA (US); Richard R. Bott, Kirkland, WA (US); David A. Estell, San Mateo, CA (US); Gudrun Vogtentanz, Sunnyvale, CA (US); Sina Pricelius, Leiden (NL); Jian Yao, Sunnyvale, CA (US)

(73) Assignee: Danisco US Inc., Palo Alto, CA (US)

( * ) Notice: Subject to any disclaimer, the term of this patent is extended or adjusted under 35 U.S.C. 154(b) by 713 days.

(21) Appl. No.: 16/305,259

(22) PCT Filed: May 31, 2017

(86) PCT No.: PCT/US2017/035217
§ 371 (c)(1),
(2) Date: Nov. 28, 2018

(87) PCT Pub. No.: WO2017/210295
PCT Pub. Date: Dec. 7, 2017

(65) Prior Publication Data
US 2020/0332229 A1    Oct. 22, 2020

Related U.S. Application Data

(60) Provisional application No. 62/343,618, filed on May 31, 2016.

(51) Int. Cl.
C11D 3/386    (2006.01)
C12N 9/54     (2006.01)
C12N 15/52    (2006.01)

(52) U.S. Cl.
CPC .............. *C11D 3/386* (2013.01); *C12N 9/54* (2013.01); *C12N 15/52* (2013.01); *C12Y 304/21062* (2013.01)

(58) Field of Classification Search
CPC ................ C11D 3/38681; C11D 3/386; C12Y 304/21062; C12N 9/54; C12N 15/52; C12N 9/6424; A61P 31/00; A61P 17/02
See application file for complete search history.

(56) References Cited

U.S. PATENT DOCUMENTS

| | | | | |
|---|---|---|---|---|
| 6,586,221 B2 * | 7/2003 | Graycar | ................. | C12N 9/54 435/219 |
| 7,510,859 B2 * | 3/2009 | Wieland | ............. | C11D 3/38636 424/401 |
| 2005/0281773 A1 | 12/2005 | Wieland et al. | | |
| 2007/0128129 A1 | 6/2007 | Stehr et al. | | |

FOREIGN PATENT DOCUMENTS

| | | |
|---|---|---|
| EP | 0416967 A1 | 3/1991 |
| WO | 2004/058961 A1 | 7/2004 |
| WO | 2005/124012 A1 | 12/2005 |
| WO | 2011/014278 A1 | 2/2011 |
| WO | 2015/089447 A1 | 6/2015 |
| WO | 2016/183509 A1 | 11/2016 |
| WO | 2016/202839 A2 | 12/2016 |
| WO | 2016/205755 A1 | 12/2016 |

OTHER PUBLICATIONS

Broun et al., Catalytic plasticity of fatty acid modification enzymes underlying chemical diversity of plant lipids. Science, 1998, vol. 282: 1315-1317. (Year: 1998).*
Devos et al., Practical limits of function prediction. Proteins: Structure, Function, and Genetics. 2000, vol. 41: 98-107. (Year: 2000).*
Seffernick et al., Melamine deaminase and Atrazine chlorohydrolase: 98 percent identical but functionally different. J. Bacteriol., 2001, vol. 183 (8): 2405-2410. (Year: 2001).*
Whisstock et al., Prediction of protein function from protein sequence. Q. Rev. Biophysics., 2003, vol. 36 (3): 307-340. (Year: 2003).*
Witkowski et al., Conversion of b-ketoacyl synthase to a Malonyl Decarboxylase by replacement of the active cysteine with glutamine. Biochemistry, 1999, vol. 38: 11643-11650. (Year: 1999).*
International Search Report and Written Opinion—PCT/US2017/035217—dated Aug. 25, 2017.

* cited by examiner

*Primary Examiner* — Ganapathirama Raghu

(57) ABSTRACT

Disclosed herein is one or more subtilisin variant, nucleic acid encoding same, and compositions and methods related to the production and use thereof, including one or more subtilisin variant that has improved stability and/or soil removal compared to one or more reference subtilisin.

15 Claims, 8 Drawing Sheets
Specification includes a Sequence Listing.

|   |   | 1 | 45 |
|---|---|---|---|
| B.lich_AprL_CAJ70731 | (1) | AQTVPYGIPLIKADKVQAQGFKGANVKVAVLDTGIQASHPDLNVV |
| B.licheniformis_BliD02339 | (1) | AQTVPYGIPLIKADKVQAQGFKGANVKVAVLDTGIQASHPDLNVV |
| B.licheniformis_AEQ38580 | (1) | AQTVPYGIPLIKADKVQAQGFKGANVKVAVLDTGIQASHPDLNVV |
| B.licheniformis_AKI30031 | (1) | AQTVPYGIPLIKADKVQAQGYKGANVKVAVLDTGIQASHPDLNVV |
| B.licheniformis_AID16241 | (1) | AQTVPYGIPLIKADKVQAQGFKGANVKVAVLDTGIQASHPDLNVV |
| B.licheniformis_AAG00493 | (1) | AQTVPYGIPLIKADKVQAQGYKGANVKVAVLDTGIQASHPDLNVV |
| B.licheniformis_AEU17777 | (1) | AQTVPYGIPLIKADKVQAQGFKGANVKVAVLDTGIQASHPDLNVV |
| B.licheniformis_EWH21773 | (1) | AQTVPYGIPLIKADKVQAQGYKGANVKVAVLDTGIQASHPDLNVV |
| B.licheniformis_AEU12640 | (1) | AQTVPYGIPLIKADKLHAQGFKGANVKGAVLATGIPTSHPDLNVV |
| B.licheniformis_CAA62666 | (1) | GQTVPYGIPLIKADKVQAQGFKGANVKVAVLDTGIQASHPDLNVV |
| Bac.sp.NSP9.1_WP_026586291 | (1) | AQTVPYGIPLIKADKVQAQGFKGANVKGVIDTGIQSSHSDLNVS |
| B.sonorensis_WP_077737098 | (1) | AQTVPYGISLIKADKVQAQGYKGANVKVGVIDTGIQSSHSDLNVS |
| Bac.sp._WP_076761713 | (1) | AQTVPYGIPLIKADKVQAQGYKGANVKVGVLDTGIQSSHSDLNVV |
| B.glyciniferentans_WP_082634659 | (1) | AQTVPYGVPLIKADKVQAQGFKGANVKVAVLDTGIAASHSDLNVV |
| CN101215534-0002 | (1) | AQTVPYGIPLIKADKVQAQGFKGANVKVAVLDTGIQASHPDLNVV |
| WO9739130-0002 | (1) | AQTVPYGIPLIKADKVQAQGFKGANVKVAVLDTGIQASHPDLNVV |
| US8110391-0009 | (1) | AQTVPYGIPLIKADKVQAQGFKGANVKVAVLDTGIQASHPDLNVV |
| JP2013500714-0110 | (1) | AQTVPYGIPLIKADKVQAQGFKGANVKVAVLDTGIQASHPDLNVV |
| WO2006122655-0031 | (1) | AQTVPYGIPLIKADKVQAQGYKGANVKVAVLDTGIQASHPDLNVV |
| US7087415-0014 | (1) | AQTVPYGIPLIKADKVQAQGFKGANVKVAVLDTGIQASHPDLNVV |
| US20110171718-0120 | (1) | GQTVPYGIPLIKADKVQAQGYKGANVKVAVLDTGIQASHPDLNVV |
| US20030049619-0014 | (1) | GQTVPYGIPLIKADKVQAQGFKGANVKVAVLDTGIQASHPDLNVV |
| JP2013500714-0121 | (1) | GQTVPYGIPLIKADKVQAQGYKGANVKVAVLDTGIQASHPDLNVV |
| US7569226-0012 | (1) | AQTVPYGIPLIKADKVQAQGYKGANVKVGIIDTGIAASHTDLKVV |
| US20050009167-0017 | (1) | AQTVPYGIPLIKADKVQAQGFKGANVKVGIIDTGIAASHTDLKVV |
| US20110171718-0098 | (1) | AQTVPYGIPLIKADKVQAQGYKGANVKVGIIDTGIASSHTDLKVV |
| WO2017006266-0002 | (1) | AQTVPYGIPLIKADKVQAQGFKGANVKVAVLDTGIQASHPDLNVV |

*FIG. 1AA*

| *FIG. 1A* | *FIG. 1AA* |
|---|---|
|  | *FIG. 1AB* |

```
                                    46                                                   90
B.lich_AprL_CAJ70731        (46)  GGASFVAGEAYN-TDGNGHGTHVAGTVAALDNTTGVLGVAPSVSL
B.licheniformis_BliD02339   (46)  GGASFVAGEAYN-TDGNGHGTHVAGTVAALDNTTGVLGVAPNVSL
B.licheniformis_AEQ38580    (46)  GGASFVAGEAYN-TDGNGHGTHVAGTVAALDNTTGVLGVAPSVSL
B.licheniformis_AKI30031    (46)  GGASFVAGEAYN-TDCNGHGTHVAGTVAALDNTTGVLGVAPSVSL
B.licheniformis_AID16241    (46)  GGASFVAGEAYN-TDGNGHGTHVAGTVAALDNTTGVLGVAPSVSL
B.licheniformis_AAG00493    (46)  GGASFVAGEAYN-TDGNGHGTHVAGTVAALDNTTGVLGVAPSVSL
B.licheniformis_AEU17777    (46)  DGASFVAGEAYN-TDGHGHGTHVAGTVAALDNTTGVLGVAPSVSL
B.licheniformis_EWH21773    (46)  GGASFVAGEAYN-TDGNGHGTHVAGTVAALDNTTGVLGVAPSVSL
B.licheniformis_AEU12640    (46)  GGASFVAGEAYN-TDGNGHGTHVAGTVAALDNTTGVLGVAPNVSL
B.licheniformis_CAA62666    (46)  GGASFVAGEAYN-TDGNGHGTHVAGTVAALDNTTGVLGVAPSVSL
Bac.sp.NSP9.1_WP_026586291  (46)  GGASFVSGDSNPFIDGNGHGTHVAGTVAALDNSIGVLGVAPNVSL
B.sonorensis_WP_077737098   (46)  GGASFVSGDSNPFIDGNGHGTHVAGTVAALDNSIGVLGVAPNVSL
Bac.sp._WP_076761713        (46)  GGASFVSGDSNPYNDGNGHGTHVAGTVAALDNSIGVLGVAPNVSL
B.glycinifermentans_WP_082634659 (46) GGASFVSGESYN-TDGNGHGTHVAGTVAALDNTTGVLGVAPNVSL
CN101215534-0002            (46)  GGASFVAGEAYN-TDGNGHGTHVAGTVAALDNTTGVLGVAPSVSL
WO9739130-0002              (46)  GGASFVAGEAYN-TDGNGHGTHVAGTVAALDNTTGVLGVAPSVSL
US81103910009               (46)  GGASFVAGEAYN-TDGNGHGTHVAGTVAALDNTTG-LGVAPSVSL
JP20135007140110            (46)  GGASFVAGEAYN-TDGNGHGTHVAGTVAALDNTTGVLGVAPSVSL
WO20061226550031            (46)  GGASFVAGEAYN-TDGNGHGTHVAGTVAALDNTTGVLGVAPSVSL
US70874150014               (46)  GGASFVAGEAYN-TDGNGHGTHVAGTVAALDNTTGVLGVAPNVSL
US201101717180120           (46)  GGASFVAGEAYN-TDGNGHGTHVAGTVAALDNTTGVLGVAPNVSL
US200300496190014           (46)  GGASFVAGEAYN-TDGNGHGTHVAGTVAALDNTTGVLGVAPSVSL
JP20135007140121            (46)  GGASFVAGEAYN-TDGNGHGTHVAGTVAALDNTTGVLGVAPSVSL
US75692260012               (46)  GGASFVSGESYN-TDGNGHGTHVAGTVAALDNTTGVLGVAPNVSL
US200500091670017           (46)  GGASFVSGESYN-TDGNGHGTHVAGTVAALDNTTGVLGVAPNVSL
US201101717180098           (46)  GGASFVSGESYN-TDGNGHGTHVAGTVAALDNTTGVLGVAPNVSL
WO20170062660002            (46)  GGASFVAGEAYN-TDGNGHGTHVAGTVAALDNTTGVLGVAPSVSL
```

*FIG. 1AB*

```
                                    91                                                                    135
B.lich_AprL_CAJ70731       (90) YAVKVLNSSGSGSYSGIVSGIEWATTNGMDVINMSLGGASGSTAM
B.licheniformis_BliD02339  (90) YAVKVLNSSGSGSYSGIVSGIEWATTNGMDVINMSLGGPSGSTAM
B.licheniformis_AEQ38580   (90) YAVKVLNSSGSGSYSGIVSGIEWATTNGMDVINMSLGGASGSTAM
B.licheniformis_AKI30031   (90) YAVKVLNSSGSGSYSGIVSGIEWATTNGMDVINMSLGGASGSTAM
B.licheniformis_AID16241   (90) YAVKVLNSSGSGSYSGIVSGIEWATTNGMDVINMSLGGASGSTAM
B.licheniformis_AAG00493   (90) YAVKVLNSSGSGSYSGIVSGIEWATTNGMDVINMSLGGASGSTAM
B.licheniformis_AEU17777   (90) YAVKVLNSSGSGSYSGIVSGIEWATTNGMDVINMSLGGASGSTAM
B.licheniformis_EWH21773   (90) YAVKVLNSSGSGSYSGIVSGIEWATTNGMDVINMSLGGASGSTAM
B.licheniformis_AEU12640   (90) YAVKVLNSSGSGSYSGIVSGIEWATTNGMDVINMSLGGASGSTAM
B.licheniformis_CAA62666   (90) YAVKVLNSSGSGSYSGIVSGIEWVTTNGMDVINMSLGGASGSTAM
Bac.sp.NSP9.1_WP_026586291 (91) YAIKVLNSSGSGTYSAIVSGIEWATSNGMDVINMSLGGSSGSTAL
B.sonorensis_WP_077737098  (91) YAIKVLNSSGSGTYSAIVSGIEWATSNGMDVINMSLGGSSGSTAL
Bac.sp._WP_076761713       (91) YAIKVLNSSGSGTYSAIVSGIEWATANGMDVINMSLGGSSGSTAL
B.glycinifermentans_WP_082634659 (90) YAVKVLNSSGSGSYSGIVSGIEWATANNLDVINMSLGGASGSTAM
CN101215534-0002           (90) YAVKVLNSSGSGSYSGIVSGIEWATTNGMDVINMSLGGASGSTAM
WO9739130-0002             (90) YAVKVLNSSGSGSYSGIVSGIEWATTNGMDVINMSLGGPSGSTAM
US8110391-0009             (90) YAVKVLNSSGSGSYSGIVSGIEWATTNGMDVINMSLGGPSGSTAM
JP20135007141-0110         (90) YAVKVLNSSGSGSYSGIVSGIEWATTNGMDVINMSLGGPSGSTAM
WO20061226655-0031         (90) YAVKVLNSSGSGSYSGIVSGIEWATTNGMDVINMSLGGPSGSTAM
US7087415-0014             (90) YAVKVLNSSGSGSYSGIVSGIEWATTNGMDVINMSLGGPSGSTAM
US20110171718-0120         (90) FAVKVLNSSGSGSYSGIVSGIEWATTNGMDVINMSLGGPSGSTAM
US20030049619-0014         (89) FAVKVLNSSGSGSYSGIVSGIEWATTNGMDVINMSLGGPSGSTAM
JP20135007141-0121         (90) YAVKVLNSSGSGSYSGIVSGIEWATTTGMDVINMSLGGASVSTAM
US7569226-0012             (90) YAIKVLNSSGSGTYSAIVSGIEWATQNGLDVINMSLGPSGSTAL
US20050009167-0017         (90) YIAKVLNSSGSGTYSAIVSGIEWATQNGLDVINMSLGPSGSTAL
US20110171718-0098         (90) YAIKVLNSSGSGTYSAIVSGIEWATQNGLDVINMSLGPSGSTAL
WO2017006266-0002          (90) YAVKVLNSSGSGSYSGIVSGIEWATTNGMDVINMSLGGASGSTAM
```

*FIG. 1BA*

| *FIG. 1B* | *FIG. 1BA* |
|---|---|
| | *FIG. 1BB* |

```
                              136                                                            180
B.lich_AprL_CAJ70731       (135) KQAVDNAYARGVVVVAAAGNSGSSGNTNTIGYPAKYDSVIAVGAV
B.licheniformis_BliD02339  (135) KQAVDNAYARGVVVVAAAGNSGSSGNTNTIGYPAKYDSVIAVGAV
B.licheniformis_AEQ38580   (135) KQAVDNAYARGVVVVAAAGNSGSSGNTNTIGYPAKYDSVIAVGAV
B.licheniformis_AKI30031   (135) KQAVDNAYARGVVVVAAAGNSGSSGNTNTIGYPAKYDSVIAVGAV
B.licheniformis_AID16241   (135) KQAVDNAYARGVVVVAAAGNSGSSGNTNTIGYPAKYDSVIAVGAV
B.licheniformis_AAG00493   (135) KQAVDNAYARGVVVVAAAGNSGSSGNTNTIGYPAKYDSVIAVGAV
B.licheniformis_AEU17777   (135) KQAVDNAYARGVVVVAAAGNSGSSGNTNTIGYPAKYDSVIAVGAV
B.licheniformis_EWH21773   (135) KQAVDNAYARGVVVVAAAGNSGSSGNANTIGYPAKYDSVIAVGAV
B.licheniformis_AEU12640   (135) KQAVDNAYAKGVVVVAAAGNSGSSGNTNTIGYPAKYDSVIAVGAV
B.licheniformis_CAA62666   (135) KQAVDNAYARGVVVVAAAGNSGSSGNTNTIGYPAKCDSVIPVGGE
Bac.sp.NSP9.1_WP_026586291 (136) KQAVDNAYARGVVVVAAAGNSGSSSNTIGYPAKYDSVIAVGAV
B.sonorensis_WP_077737098  (136) KQAVDNAYARGVVVVAAAGNSGSSGSNTIGYPAKYDSVIAVGAV
Bac.sp._WP_076761713       (136) KQAVDRAYSSGVVVVAAAGNSGTSGSSANTIGYPAKYDSVIAVGAV
B.glyciniferментans_WP_082634659 (135) KQAVDKAYASGVVVVAAAGNSGTSGSSTIGYPAKYDSVIAVGAV
CN101215534-0002           (135) KQAVDNAYARGVVVVAAAGNSGSSGNTNTIGYPAKYDSVIAVGAV
WO9739130-0002             (135) KQAVDNAYARGVVVVAAAGNSGSSGYTNTIGYPAKYDSVIAVGAV
US8110391-0009             (135) KQAVDNAYSKGVVVPVAAAGNSGSSGYTNTIGYPAKYDSVIAVGAV
JP2013500714-0110          (135) KQAVDNAYARGVVVVAAAGNSGNSGSTNTIGYPAKYDSVIAVGAV
WO2006122655-0031          (135) KQAVDNAYARGVVVVAAAGNSGSSGNTNTIGYPAKYDSVIAVGAV
US7087415-0014             (135) KQAVDNAYSKGVVPVAAAGNSGSSGYTNTIGYPAKYDSVIAVGAV
US20110171718-0120         (135) KQAVDNAYSKGVVPVAAAGNSGSSGYTNTIGYPAKYDSVIAVGAV
US20030049619-0014         (134) KQAVDNAYARGAVVVSSAGNSGSSGNTNTIGYPAKYDSVIAVGAV
JP2013500714-0121          (135) KQAVDHAYARGAVVVSSAGNSGSSGNTNTIGYPAKYDSVIAVGAV
US7569226-0012             (135) KQAVDKAYASGIVVVAAAGNSGSSGSQNTIGYPAKYDSVIAVGAV
US20050009167-0017         (135) KQAVDKAYASGIVVVAAAGNSGSSGSQNTIGYPAKYDSVIAVGAV
US20110171718-0098         (135) KQAVDNAYAKGVVVVAAAGNSGSSGNTNTIGYPAKYDSVIAVGAV
WO2017006266-0002          (135) KQAVDNAYAKGVVVVAAAGNSGSSGNTNTIGYPAKYDSVIAVGAV
```

FIG. 1BB

| | | 181 225 |
|---|---|---|
| B.lich_AprL_CAJ70731 | (180) | DSNSNRASFSSVGAELEVMAPGAG-VYSTYPTNTYATLNGTSMAS |
| B.licheniformis_BliD02339 | (180) | DSNSNRASFSSSVGAKLEVMAPGAG-VYSTYPTSTYATLNGTSMAS |
| B.licheniformis_AEQ38580 | (180) | DSNSNRASFSSSVGAELEVMAPGAGGVYSTYPTNTYATLNGTSMAS |
| B.licheniformis_AKI30031 | (180) | DSNSNRASFSSSVGAELEVMAPGAG-VYSTYPTNTYATLNGTSMAS |
| B.licheniformis_AID16241 | (180) | DSNGNRASFSSSVGAELEVMAPGAG-VYSTYPTNTYATLNGTSMAS |
| B.licheniformis_AAG00493 | (180) | DSNSNRASFSSSVGAELEVMAPGAG-VYSTYPTSTYATLNGTSMAS |
| B.licheniformis_AEU17777 | (180) | DSNSNRASFSSSVEAELEVMAPGAG-VYSTYPTNTYATLNGTSMAS |
| B.licheniformis_EWH21773 | (180) | DSNSNRASFSSSVGAELEVMAPGAS-VYSTYPTSTYATLNGTSMAS |
| B.licheniformis_AEU12640 | (180) | DSNSNRASFSSSVGAELEVMAPGAG-VYSTYPTNTYATLNGTSMAS |
| B.licheniformis_CAA62666 | (180) | DSNSNRSSFSSSVGAELEVMAPVSG-VYSTYPTNTYTTLNGTSMAS |
| Bac.sp.NSP9.1_WP_026586291 | (181) | DSNSNRASYSSSVGSELEVMAPGSG-VYSTYPSNTYATLNGTSMAS |
| B.sonorensis_WP_077737098 | (181) | DSNSNRASYSSSVGSELEVMAPGSG-VYSTYPSNTYATLNGTSMAS |
| Bac.sp._WP_076761713 | (181) | DSNSNRASFSSSVGAELEVMAPGSA-VYSTYPANTYATLNGTSMAS |
| B.glycinifermentans_WP_082634659 | (180) | NSSNQRASFSSSVGPELDVVAPGVS-IYSTYPSNTYATLNGTSMAS |
| CN101215534-0002 | (180) | DSNSNRASFSSSVGAELEVMAPGAG-VYSTYPTNTYATLNGTSMVS |
| WO9739130-0002 | (180) | DSNSNRASFSSSVGAELEVMAPGAG-VYSTYPTNTYATLNGTSMAS |
| US8110391-0009 | (180) | DSNSNRASFSSSVGAELEVMAPGAG-VYSTYPTSTYATLNGTSMAS |
| JP2013500714-0110 | (180) | DSNSNRASFSSSVGAELEVMAPGAG-VYSTYPTSTYATLNGTSMAS |
| WO2006122655-0031 | (180) | DSNSNRASFSSSVGAELEVMAPGAG-VYSTYPTSTYATLNGTSMAS |
| US7087415-0014 | (180) | DPNSNRASFSSSVGAELEVMAPGAG-VYSTYPTNTYATLNGTSMAS |
| US20110171718-0120 | (180) | DSNSNRASFSSSVGAELEVMAPGAG-VYSTYPTNTYATLNGTSMAS |
| US20030049619-0014 | (179) | DSNSNRASFSSSVGAELEVMAPGAG-VYSTYPTNTYATLNGTSMAS |
| JP2013500714-0121 | (180) | DSNSNRASFSSSVGAELEVMAPGAG-VYSTYPTNTYATLNGTSMAS |
| US7569226-0012 | (180) | DSNKNRASFSSSVGAELEVMAPGVS-VYSTYPSNTYTSLNGTSMAS |
| US20050009167-0017 | (180) | DSNKNRASFSSSVGAELEVMAPGVS-VYSTYPSNTYTSLNGTSMAS |
| US20110171718-0098 | (180) | DSNKNRASFSSSVGSELEVMAPGVS-VYSTYPSNTYTSLNGTSMAS |
| WO2017006266-0002 | (180) | DSNSNRASFSSSVGAELEVMAPGAG-VYSTYPTNTYATLNGTSMAS |

*FIG. 1CA*

| *FIG. 1C* | *FIG. 1CA* |
|---|---|
| | *FIG. 1CB* |

```
                            226                                                      270
B.lich_AprL_CAJ70731        (224) PHVAGAAALILSKHPNLSASQVRNRLSSTATYLGSSFYYGKGLIN
B.licheniformis_BliD02339   (224) PHVAGAAALILSKHPNLSASQVRNRLSSTATYLGSSFYYGKGLIN
B.licheniformis_AEQ38580    (225) PHVAGAAALILSKHPNLSASQVRNRLSSTATYLGSSFYYGKGLIN
B.licheniformis_AKI30031    (224) PHVAGAAALILSKHPNLSASQVRNRLSSTATYLGSSFYYGKGLIN
B.licheniformis_AID16241    (224) PHVAGAAALILSKHPNLSASQVRNRLSSTATYLGSSFYYGKGLIN
B.licheniformis_AAG00493    (224) PHVAGAAALILSKHPNLSASQVRNRLSSTATYLGSSFYYGKGLIN
B.licheniformis_AEU17777    (224) PHVAGAAALILSKHPNLSASQVRNRLSSTATYLGSSFYYGKGLIN
B.licheniformis_EWH21773    (224) PHVAGAAALILSKHPNLSASQVRNRLSSTATYLGSSFYYGKGLIN
B.licheniformis_AEU12640    (224) PHVAGAAALILSKHPNLSASQVRNRLSRTATYLGSSFYYGKGLIN
B.licheniformis_CAA62666    (224) PHVAGTSALILSKHPNLSASQVRNRLSSTATYLGSSFYYGNGLIN
Bac.sp.NSP9.1_WP_026586291  (225) PHVAGAAALILSKYPTLSASQVRNRLSSTATYLGSSFYYGNGLIN
B.sonorensis_WP_077737098   (225) PHVAGAAALVLSKYPTLSASQVRDRLSSTATNLGDSFYYGKGLIN
Bac.sp._WP_076761713        (225) PHVAGAAALILSKSPALSASQVRNRLSSTATYLGSSFYYGKGLIN
B.glycinifermentans_WP_082634659 (224) PHVAGAAALILSKHPNLSASQVRNRLSSTATYLGSSFYYGKGLIN
CN101215534-0002            (224) PHVAGAAALILSKHPNLSASQVRNRLSSTATYLGSSFYYGKGLIN
WO9739130-0002              (224) PHVAGAAALILSKHPNLSASQVRNRLSSTATYLGSSFYYGKGLIN
US8110391-0009              (224) PHVAGAAALILSKHPNLSASQVRNRLSSTATYLGSSFYYGKGLIN
JP2013500714-0110           (224) PHVAGAAALILSKHPNLSASQVRTRLSRTATYLGSSFYYGKGLIN
WO2006122655-0031           (224) PHVAGAAALILSKHPNLSASQVRNRLSSTATYLGSSFYYGKGLIN
US7087415-0014              (224) PHVAGAAALILSKHPNLSASQVRNRLSSTATYLGSSFYYGKGLIN
US20110171718-0120          (224) PHVAGAAALILSKHPNLSASQVRNRLSSTATYLGSSFYYGKGLIN
US20030049619-0014          (223) PHVAGAAALILSKHPNLSASQVRNRLSSTATYLGSSFYYGKGLIN
JP2013500714-0121           (224) PHVAGAAALILSKHPNLSASQVRNRLSSTATYLGSSFYYGRGLIN
US7569226-0012              (224) PHVAGAAALILSKYPTLSASQVRNRLSSTATNLGDSFYYGKGLIN
US20050009167-0017          (224) PHVAGAAALILSKYPTLSASQVRNRLSSTATNLGDSFYYGKGLIN
US20110171718-0098          (224) PHVAGAAALILSKYPTLSASQVRNRLSSTATNLGDSFYYGKGLIN
WO2017006266-0002           (224) PHVAGAAALILSKHPNLSASQVRNRLSSTATYLGSSFYYGKGLIN
```

*FIG. 1CB*

```
                                           271
           B.lich_AprL_CAJ70731 (269) VEAAAQ (SEQ ID NO:2)
         B.licheniformis_BliD02339 (269) VEAAAQ (SEQ ID NO:9)
         B.licheniformis_AEQ38580 (270) VEAAAQ (SEQ ID NO:180)
         B.licheniformis_AKI30031 (269) VEAAAQ (SEQ ID NO:182)
         B.licheniformis_AID16241 (269) VEAAAQ (SEQ ID NO:184)
         B.licheniformis_AAG00493 (269) VEAAAQ (SEQ ID NO:186)
         B.licheniformis_AEU17777 (269) VEAAAQ (SEQ ID NO:187)
         B.licheniformis_EWH21773 (269) VEAAAQ (SEQ ID NO:188)
         B.licheniformis_AEU12640 (269) VEAAAQ (SEQ ID NO:189)
         B.licheniformis_CAA62666 (269) VEAAAQ (SEQ ID NO:190)
         Bac.sp.NSP9.1_WP_026586291 (270) VEAAAQ (SEQ ID NO:192)
         B.sonorensis_WP_077737098 (270) VEAAAQ (SEQ ID NO:181)
                  Bac.sp._WP_076761713 (270) TEAAAQ (SEQ ID NO:183)
    B.glycinifermentans_WP_082634659 (269) VEAAAQ (SEQ ID NO:185)
                    CN101215534-0002 (269) VEAAAQ (SEQ ID NO:194)
                       WO9739130-0002 (269) VEAAAQ (SEQ ID NO:195)
                       US8110391-0009 (269) VEAAAQ (SEQ ID NO:196)
                    JP2013500714-0110 (269) VEAAAQ (SEQ ID NO:197)
                    WO2006122655-0031 (269) VEAAAQ (SEQ ID NO:198)
                       US7087415-0014 (269) VEAAAQ (SEQ ID NO:199)
                   US20110171718-0120 (269) VEAAAQ (SEQ ID NO:200)
                   US20030049619-0014 (268) VEAAAQ (SEQ ID NO:201)
                    JP2013500714-0121 (269) VEAAAQ (SEQ ID NO:202)
                       US7569226-0012 (269) VEAAAQ (SEQ ID NO:203)
                   US20050009167-0017 (269) VEAAAQ (SEQ ID NO:204)
                   US20110171718-0098 (269) VEAAAQ (SEQ ID NO:205)
                   WO2017006266-0002 (269) VEAAAQ (SEQ ID NO:39)
```

*FIG. 1D*

PROTEASE VARIANTS AND USES THEREOF

CROSS-REFERENCE TO RELATED APPLICATIONS

This application is related to and claims the benefit of priority from U.S. Provisional Patent Application Ser. No. 62/343,618, filed May 31, 2016, which is hereby incorporated herein by reference in its entirety.

REFERENCE TO SEQUENCE LISTING SUBMITTED ELECTRONICALLY

The content of the sequence listing electronically submitted with the application as an ASCII text file (Name: NB40785WOPCT_ST25; Size: 882 KB; Created: May 26, 2017) forms part of the application and is hereby incorporated herein by reference in its entirety.

Disclosed herein is one or more subtilisin variant, nucleic acid encoding same, and compositions and methods related to the production and use thereof, including one or more subtilisin variant that has improved stability and/or soil removal compared to one or more reference subtilisin.

Serine proteases are enzymes (EC No. 3.4.21) possessing an active site serine that initiates hydrolysis of peptide bonds of proteins. Serine proteases comprise a diverse class of enzymes having a wide range of specificities and biological functions that are further divided based on their structure into chymotrypsin-like (trypsin-like) and subtilisin-like. The prototypical subtilisin (EC No. 3.4.21.62) was initially obtained from *Bacillus subtilis*. Subtilisins and their homologues are members of the S8 peptidase family of the MEROPS classification scheme. Members of family S8 have a catalytic triad in the order Asp, His and Ser in their amino acid sequence. Although a number of useful variant proteases have been developed for cleaning applications, there remains a need for improved protease variants.

One embodiment provides one or more subtilisin variant comprising an amino acid sequence comprising two, three, or four or more variations at positions corresponding to SEQ ID NO:2, wherein said positions are selected from: (i) 1, 3, 9, 10, 15, 22, 24, 26, 27, 28, 29, 30, 31, 35, 37, 40, 43, 45, 48, 52, 68, 71, 76, 77, 78, 86, 87, 95, 96, 98, 99, 100, 101, 102, 103, 105, 108, 111, 114, 115, 117, 119, 123, 125, 126, 127, 128, 129, 130, 136, 143, 146, 147, 151, 155, 158, 160, 161, 165, 184, 187, 193, 202, 203, 204, 210, 211, 216, 217, 234, 238, 239, 242, 243, 250, 255, 258, 259, 260, 264, and 274; (ii) 1, 3, 9, 10, 15, 22, 24, 26, 28, 29, 30, 31, 35, 37, 40, 45, 48, 52, 68, 71, 76, 77, 78, 86, 87, 95, 96, 98, 99, 100, 101, 102, 105, 108, 111, 114, 115, 117, 119, 123, 125, 126, 127, 128, 129, 130, 136, 143, 146, 147, 151, 155, 158, 160, 161, 165, 184, 187, 193, 202, 203, 204, 210, 211, 216, 217, 234, 238, 239, 242, 243, 250, 255, 258, 259, 260, 264, and 274; (iii) 1, 3, 9, 10, 24, 26, 29, 30, 31, 35, 37, 40, 45, 48, 52, 68, 71, 77, 78, 86, 87, 95, 96, 98, 99, 100, 101.102, 105.108, 111, 115, 117, 119, 123, 127, 128, 129.130, 136.143, 146, 147, 151, 155, 158, 160, 161, 165, 184, 187, 193, 202, 203, 204, 210, 211, 216, 217, 234, 238, 239, 242, 243, 250, 258, 259, 260, 264, and 274; (iv) 3, 9, 10, 35, 68, 77, 78, 86, 87, 99, 101, 115, 123, 127, 128, 165, 184, 187, 202, 203, 210, 217, 242, 250, 258, and 264; or (v) 3, 68, 77, 78, 123, 127, 128, 165, 184, 202, 210, 217, and 258; with the proviso that one or more of said two, three, or four or more variations is a man-made mutation or substitution; wherein said variant has at least 85% but less than 100% amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

Yet another embodiment provides one or more subtilisin variant comprising an amino acid sequence comprising two, three, or four or more amino acid substitutions at two, three, or four or more positions corresponding to SEQ ID NO:2, wherein said substitutions are selected from: (i) 1Q, 3Q/V, 9E, 10M, 15I, 22Y, 24N/Q, 26Q, 27R, 28A, 29S, 30T, 31I, 35A, 37T, 40E, 43A, 45I/Q/R, 48I/T/V, 52R, 68S, 71A, 76K, 77D/E/H/N/Q/S, 78I, 86H/N/R. 87S/T, 95A/F/Q, 96S, 98H/R. 99A/E/Q/S, OON, 101A, 102D/T, 103I, 105N, 108H/K, 111Q, 114N, 115F. 117S, 119Q, 123I, 125N, 126Q, 127E/F/Q/S/T/V, 128P/R/S, 129H/R. 130S, 136N/R, 143Q/V, 146A/S, 147L, 151G, 155E/G/N, 158D/N/Q, 160C/D/K, 161D/Q, 165A/E/Q/S, 184E/Q, 187E/P, 193D/Q, 202V, 203E/N/Q, 204, 21E/H/I/P, 211S, 216Q, 217S, 234I/W, 238Q/R, 239K/S/T, 242G/N, 243, 250G, 255R, 258D/E/P, 259E/P, 260W, 264H/Q/S, and 274A; (ii) 1Q, 3Q/V, 9E, 10M, 15I, 22Y, 24N/Q, 26Q, 28A, 29S, 30T, 31I, 35A, 37T, 40E, 45I/Q/R, 48I1N, 52R, 68S, 71A, 76K, 77D/E/H/N/S, 78I, 86H/N/R87S/T, 95A/F/Q, 96S, 98K/R, 99A/E/Q/S, 100N, 101A, 102D/T, 105N, 108H/K, 111Q, 114N, 115F, 117S, 119Q, 123I, 125N, 126Q, 127E/F/Q/S/N, 128P/R/S, 129H/R, 130S, 136N, 143Q/V, 146A/S, 147L, 151O, 155E/G/N, 158D/N/Q, 160D/K, 161D/Q, 165A/E/Q/S. 184E/Q, 187E/P, 193D/Q, 194E, 202V, 203E/N/Q, 204I, 210I/P, 211S, 216Q, 217S, 234I/W, 238Q/R, 239K/ST, 242G/N, 243I, 250G, 255R, 258D/P, 259E/P, 260W, 264H/Q/S, and 274A; (iii) 1Q, 3V, 9E, 10M, 24Q, 26Q, 29S, 30T, 31I, 35A, 37T, 40E, 45I/Q/R, 48T/V, 52R, 68S, 71A, 77E/N, 78I, 86H/R, 87S, 95A/F, 96S, 98R, 99A/E/Q/S, 100N, 101A, 102DT, 105N, 108, 11Q, 115F, 117S, 119Q, 123I, 127E/Q/S/N, 128P/R, 129H/R, 130S, 136N, 143Q/V, 146A, 147L, 151G, 155G/N, 158D/N/Q, 160D/K. 161D/Q, 165A/E/Q, 184E/Q, 187E/P, 193Q, 202V, 203E/N/Q, 204I, 210I/P, 211S, 216Q217S, 234W, 238Q, 239S, 242G/N, 243, 250G, 258D/P, 259E/P, 260W, 264H/Q/S, and 274A; (iv) 3V, 9E, 10M, 35A, 68S, 77N, 78I, 86H, 87S, 99Q/S, 10A, 115F, 123I, 127S/T, 128P/R, 165E/Q, 184Q, 187E, 202V, 203E, 210P, 217S, 242G, 250G, 258D/P, and 264H; or (v) 3V, 68S, 77N, 78I. 123I, 127S. 128P, 165Q, 184Q, 202V, 210P, 217S, and 258D/P; with the proviso that one or more of said two, three, or four or more substitutions is a man-made substitution; wherein said variant has at least 85% but less than 100% amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5. Motif 6, Motif 7, Motif 8, Motif 9, Motif 10. Motif 11, Motif 12, Motif 13, and Motif 14; and wherein the amino acid positions of the variant are numbered by correspondence with the amino acid sequence of SEQ ID NO:2.

In one embodiment, the AprL-clade enzymes comprise Motif A, Motif B, or a combination thereof. In other embodiments, the AprL-clade enzymes comprise Motif A and Motif B. In some embodiments, one or more subtilisin variant described herein comprises Motif A, Motif B, or a combination thereof. In still other embodiments, one or more subtilisin variant described herein comprises Motif A and Motif B. In another embodiment, Motif A is selected from Motif 1, Motif 2, Motif 3, and Motif 4. In a still further embodiment, Motif B is selected from Motif 5, Motif 6, Motif 7, Motif 8, Motif 9, Motif 10, Motif 11, Motif 12, Motif 13, and Motif 14.

Some embodiments are directed to a composition comprising one or more subtilisin variant described herein. Further embodiments are directed to a method of cleaning comprising contacting a surface or an item in need of cleaning with one or more subtilisin variant described herein or one or more composition described herein.

BRIEF DESCRIPTION OF THE DRAWINGS

FIG. 1A-1D provides a CLUSTAL W sequence alignment of AprL, Blid02339, and other AprL-clade enzymes.

DETAILED DESCRIPTION

Figure 2:
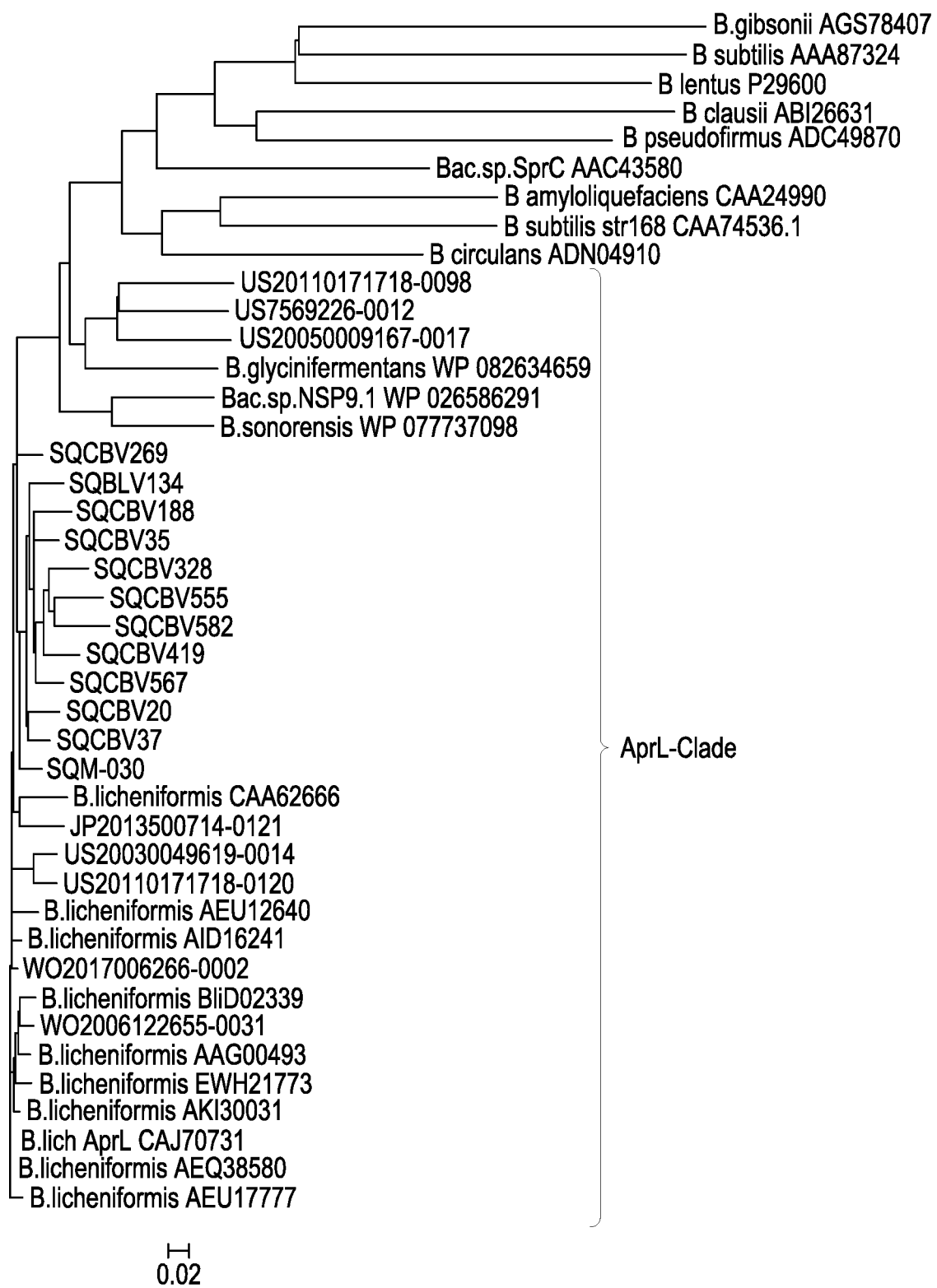
FIG. 2 provides a phylogenetic tree of subtilisins including AprL, Blid02339, other members of the AprL-clade, and other subtilisins, including variants described herein.

Unless otherwise indicated herein, one or more subtilisin variant described herein can be made and used via conventional techniques commonly used in molecular biology, microbiology, protein purification, protein engineering, protein and DNA sequencing, recombinant DNA fields, and industrial enzyme use and development. Terms and abbreviations not defined should be accorded their ordinary meaning as used in the art. Unless defined otherwise herein, all technical and scientific terms used herein have the same meaning as commonly understood by one of ordinary skill in the art. Any definitions provided herein are to be interpreted in the context of the specification as a whole. As used herein, the singular "a," "an" and "the" includes the plural unless the context clearly indicates otherwise. Unless otherwise indicated, nucleic acid sequences are written left to right in 5' to 3' orientation; and amino acid sequences are written left to right in amino to carboxy orientation. Each numerical range used herein includes every narrower numerical range that falls within such broader numerical range, as if such narrower numerical ranges were all expressly written herein.

As used herein in connection with a numerical value, the term "about" refers to a range of +/−0.5 of the numerical value, unless the term is otherwise specifically defined in context. For instance, the phrase a "pH value of about 6" refers to pH values of from 5.5 to 6.5, unless the pH value is specifically defined otherwise.

The nomenclature of the amino acid substitutions or variations of the one or more subtilisin variants described herein uses one or more of the following: position; position: amino acid substitutions or variation(s); or starting amino acid(s):position:amino acid substitution(s). Reference to a "position" (i.e. 5, 8, 17, 22, etc) encompasses any starting amino acid that may be present at such position, and any variation from the starting amino acid or substitution that may be present at such position. Reference to a "position: amino acid substitution(s) and/or variation(s)" (i.e. 1S/T/G, 3G, 17T, etc) encompasses any starting amino acid that may be present at such position and the one or more amino acid(s) that may vary from the starting amino acid and/or with which such starting amino acid may be substituted. An amino acid substitution excludes the starting amino acid, where the substituted amino acid and starting amino acid are the same. Reference to a starting or substituted amino acid or an amino acid variation may be further expressed as several starting, substituted, or varied amino acids separated by a foreslash ("/"). For example, D275S/K indicates position 275 is substituted with serine (S) or lysine (K) and P/S197K indicates that starting amino acid proline (P) or serine (S) at position 197 is substituted with lysine (K).

The position of an amino acid residue in a given amino acid sequence is numbered by correspondence with the amino acid sequence of SEQ ID NO:2. That is, the amino acid sequence of the AprL-clade enzyme shown in SEQ ID NO:2 serves as a reference sequence. For example, the amino acid sequence of an AprL-clade subtilisin enzyme or one or more subtilisin variant described herein is aligned with the amino acid sequence of SEQ ID NO:2 using an alignment algorithm as described herein, and each amino acid residue in the given amino acid sequence that aligns (preferably optimally aligns) with an amino acid residue in SEQ ID NO:2 is conveniently numbered by reference to the numerical position of that corresponding amino acid residue. Sequence alignment algorithms, such as, for example, described herein will identify the location where insertions or deletions occur in a subject sequence when compared to a query sequence.

The term "variant." with respect to a polypeptide amino acid sequence, refers to a polypeptide amino acid sequence that differs from a specified wild-type, parental, or reference polypeptide amino acid sequence by including one or more man-made substitutions, insertions, or deletions of an amino acid. Similarly, the term "variant," with respect to a polynucleotide nucleic acid sequence, refers to a polynucleotide nucleic acid sequence that differs from a specified wild-type, parental, or reference polynucleotide by including one or more man-made substitutions, insertions, or deletions of a nucleic acid acid. The identity of the wild-type, parental or reference polypeptide amino acid sequence or polynucleotide nucleic acid sequence will be apparent from context.

The term "variation(s)" when used, for example, in the phrase "two, three, or four or more amino acid variations versus SEQ ID NO:2" or "two, three, or four or more variations at positions corresponding to SEQ ID NO:2" encompasses each amino acid that is different from the amino acid present at the corresponding position in SEQ ID NO:2. For example, the sequence of the variant of interest is aligned with SEQ ID NO:2 and each position in the variant compared to SEQ ID NO:2 to identify the amino acids at each position that are different from the amino acid present at the corresponding positions in SEQ ID NO:2 and each amino acid that is different from the corresponding amino acid in SEQ ID NO:2 is a variation.

The terms "protease" and "proteinase" refer to an enzyme that has the ability to break down proteins and peptides. A protease has the ability to conduct "proteolysis," by hydrolysis of peptide bonds that link amino acids together in a peptide or polypeptide chain forming the protein. This activity of a protease as a protein-digesting enzyme is referred to as "proteolytic activity." Many well-known procedures exist for measuring proteolytic activity. For example, proteolytic activity may be ascertained by comparative assays that analyze the respective protease's ability to hydrolyze a suitable substrate. Exemplary substrates useful in the analysis of protease or proteolytic activity, include, but are not limited to, di-methyl casein (Sigma C-9801), bovine collagen (Sigma C-9879), bovine elastin (Sigma E-1625), and bovine keratin (ICN Biomedical 902111). Colorimetric assays utilizing these substrates are well known in the art (See e.g., WO99/34011 and U.S. Pat. No. 6,376,450). The pNA peptidyl assay (See e.g., Del Mar et al., Anal Biochem, 99:316-320, 1979) also finds use in determining the active enzyme concentration. This assay measures the rate at which p-nitroaniline is released as the enzyme hydrolyzes a soluble synthetic substrate, such as succinyl-alanine-alanine-proline-phenylalanine-p-nitroanilide (suc-AAPF-pNA). The rate of production of yellow color from the hydrolysis reaction is measured at 410 nm on a spectrophotometer and is proportional to the active enzyme concentration. In addition, absorbance measurements at 280 nanometers (nm) can be used to determine the total protein concentration in a sample of purified protein. The activity on substrate/protein concentration gives the enzyme specific activity.

The phrase "composition(s) substantially-free of boron" or "detergent(s) substantially-free of boron" refers to composition(s) or detergent(s), respectively, that contain trace amounts of boron, for example, less than about 1000 ppm (1 mg/kg or liter equals 1 ppm), less than about 100 ppm, less than about 50 ppm, less than about 10 ppm, or less than about 5 ppm, or less than about 1 ppm, perhaps from other compositions or detergent constituents.

As used herein, "the genus *Bacillus*" includes all species within the genus "*Bacillus*," as known to those of skill in the art, including but not limited to *B. subtilis, B. licheniformis, B. lentus, B. brevis, B. stearothermophilus, B. alkalophilus, B. amyloliquefaciens, B. clausii, B. halodurans, B. megaterium, B. coagulans, B. circulans, B. gibsonii*, and *B. thuringiensis*. It is recognized that the genus *Bacillus* continues to undergo taxonomical reorganization. Thus, it is intended that the genus include species that have been reclassified, including but not limited to such organisms as *B. stearothermophilus*, which is now named "*Geobacillus stearothermophilus*", or *B. polymyxa*, which is now "*Paenibacillus polymyxa*". The production of resistant endospores under stressful environmental conditions is considered the defining feature of the genus *Bacillus*, although this characteristic also applies to the recently named *Alicyclobacillus, Amphibacillus, Aneurinibacillus, Anoxybacillus, Brevibacillus, Filobacillus, Gracilibacillus, Halobacillus, Paenibacillus, Salibacilus, Thermobacillus, Ureibacillus*, and *Virgibacillus*.

As used herein, the term "mutation" refers to man-made changes to a reference amino acid or nucleic acid sequence. It is intended that the term encompass man-made substitutions, insertions and deletions.

As used herein, the term "vector" refers to a nucleic acid construct used to introduce or transfer nucleic acid(s) into a target cell or tissue. A vector is typically used to introduce foreign DNA into a cell or tissue. Vectors include plasmids, cloning vectors, bacteriophages, viruses (e.g., viral vector), cosmids, expression vectors, shuttle vectors, and the like. A vector typically includes an origin of replication, a multi-cloning site, and a selectable marker. The process of inserting a vector into a target cell is typically referred to as transformation. The present invention includes, in some embodiments, a vector that comprises a DNA sequence encoding a serine protease polypeptide (e.g., precursor or mature serine protease polypeptide) that is operably linked to a suitable prosequence (e.g., secretory, signal peptide sequence, etc.) capable of effecting the expression of the DNA sequence in a suitable host, and the folding and translocation of the recombinant polypeptide chain.

As used herein in the context of introducing a nucleic acid sequence into a cell, the term "introduced" refers to any method suitable for transferring the nucleic acid sequence into the cell. Such methods for introduction include but are not limited to protoplast fusion, transfection, transformation, electroporation, conjugation, and transduction. Transformation refers to the genetic alteration of a cell which results from the uptake, optional genomic incorporation, and expression of genetic material (e.g., DNA).

"Expression cassette" or "expression vector" refers to a nucleic acid construct or vector generated recombinantly or synthetically for the expression of a nucleic acid of interest (e.g., a foreign nucleic acid or transgene) in a target cell. The nucleic acid of interest typically expresses a protein of interest. An expression vector or expression cassette typically comprises a promoter nucleotide sequence that drives or promotes expression of the foreign nucleic acid. The expression vector or cassette also typically includes other specified nucleic acid elements that permit transcription of a particular nucleic acid in a target cell. A recombinant expression cassette can be incorporated into a plasmid, chromosome, mitochondrial DNA, plastid DNA, virus, or nucleic acid fragment. Some expression vectors have the ability to incorporate and express heterologous DNA fragments in a host cell or genome of the host cell. Many prokaryotic and eukaryotic expression vectors are commercially available. Selection of appropriate expression vectors for expression of a protein from a nucleic acid sequence incorporated into the expression vector is within the knowledge of those of skill in the art.

As used herein, a nucleic acid is "operably linked" with another nucleic acid sequence when it is placed into a functional relationship with another nucleic acid sequence. For example, a promoter or enhancer is operably linked to a nucleotide coding sequence if the promoter affects the transcription of the coding sequence. A ribosome binding site may be operably linked to a coding sequence if it is positioned so as to facilitate translation of the coding sequence. Typically, "operably linked" DNA sequences are contiguous. However, enhancers do not have to be contiguous. Linking is accomplished by ligation at convenient restriction sites. If such sites do not exist, synthetic oligonucleotide adaptors or linkers may be used in accordance with conventional practice.

As used herein the term "gene" refers to a polynucleotide (e.g., a DNA segment), that encodes a polypeptide and includes regions preceding and following the coding regions. In some instances a gene includes intervening sequences (introns) between individual coding segments (exons).

As used herein, "recombinant" when used with reference to a cell typically indicates that the cell has been modified by the introduction of a foreign nucleic acid sequence or that the cell is derived from a cell so modified. For example, a recombinant cell may comprise a gene not found in identical form within the native (non-recombinant) form of the cell, or a recombinant cell may comprise a native gene (found in the native form of the cell) that has been modified and re-introduced into the cell. A recombinant cell may comprise a nucleic acid endogenous to the cell that has been modified without removing the nucleic acid from the cell; such modifications include those obtained by gene replacement, site-specific mutation, and related techniques known to those of ordinary skill in the art. Recombinant DNA technology includes techniques for the production of recombinant DNA in vitro and transfer of the recombinant DNA into cells where it may be expressed or propagated, thereby producing a recombinant polypeptide. "Recombination" and "recombining" of polynucleotides or nucleic acids refer generally to the assembly or combining of two or more nucleic acid or polynucleotide strands or fragments to generate a new polynucleotide or nucleic acid.

A nucleic acid or polynucleotide is said to "encode" a polypeptide if, in its native state or when manipulated by methods known to those of skill in the art, it can be transcribed and/or translated to produce the polypeptide or a fragment thereof. The anti-sense strand of such a nucleic acid is also said to encode the sequence.

The terms "host strain" and "host cell" refer to a suitable host for an expression vector comprising a DNA sequence of interest.

A "protein" or "polypeptide" comprises a polymeric sequence of amino acid residues. The terms "protein" and "polypeptide" are used interchangeably herein. The single and 3-letter code for amino acids as defined in conformity with the IUPAC-IUB Joint Commission on Biochemical Nomenclature (JCBN) is used throughout this disclosure. The single letter X refers to any of the twenty amino acids. It is also understood that a polypeptide may be coded for by more than one nucleotide sequence due to the degeneracy of the genetic code.

A "prosequence" or "propeptide sequence" refers to an amino acid sequence between the signal peptide sequence and mature protease sequence that is necessary for the proper folding and secretion of the protease; they are sometimes referred to as intramolecular chaperones. Cleavage of the prosequence or propeptide sequence results in a mature active protease. Bacterial serine proteases are often expressed as pro-enzymes.

The terms "signal sequence" and "signal peptide" refer to a sequence of amino acid residues that may participate in the secretion or direct transport of the mature or precursor form of a protein. The signal sequence is typically located N-terminal to the precursor or mature protein sequence. The signal sequence may be endogenous or exogenous. A signal sequence is normally absent from the mature protein. A signal sequence is typically cleaved from the protein by a signal peptidase after the protein is transported.

The term "mature" form of a protein, polypeptide, or peptide refers to the functional form of the protein, polypeptide, or peptide without the signal peptide sequence and propeptide sequence.

The term "precursor" form of a protein or peptide refers to a mature form of the protein having a prosequence operably linked to the amino or carbonyl terminus of the protein. The precursor may also have a "signal" sequence operably linked to the amino terminus of the prosequence. The precursor may also have additional polypeptides that are involved in post-translational activity (e.g., polypeptides cleaved therefrom to leave the mature form of a protein or peptide).

The term "wild-type" in reference to an amino acid sequence or nucleic acid sequence indicates that the amino acid sequence or nucleic acid sequence is a native or naturally-occurring sequence. As used herein, the term "naturally-occurring" refers to anything (e.g., protein or polynucleotide sequences) that is found in nature. Conversely, the term "non-naturally occurring" refers to anything that is not found in nature (e.g., recombinant polynucleotide and protein sequences produced in the laboratory or modification of the wild-type sequence).

As used herein with regard to amino acid residue positions. "corresponding to" or "corresponds to" or "corresponds" refers to an amino acid residue at the enumerated position in a protein or peptide, or an amino acid residue that is analogous, homologous, or equivalent to an enumerated residue in a protein or peptide. As used herein, "corresponding region" generally refers to an analogous position in a related proteins or a reference protein.

The terms "derived from" and "obtained from" refer to not only a protein produced or producible by a strain of the organism in question, but also a protein encoded by a DNA sequence isolated from such strain and produced in a host organism containing such DNA sequence. Additionally, the term refers to a protein which is encoded by a DNA sequence of synthetic and/or cDNA origin and which has the identifying characteristics of the protein in question. To exemplify, "proteases derived from *Bacillus*" refers to those enzymes having proteolytic activity that are naturally produced by *Bacillus*, as well as to serine proteases like those produced by *Bacillus* sources but which through the use of genetic engineering techniques are produced by other host cells transformed with a nucleic acid encoding the serine proteases.

The term "identical" in the context of two polynucleotide or polypeptide sequences refers to the nucleic acids or amino acids in the two sequences that are the same when aligned for maximum correspondence, as measured using sequence comparison or analysis algorithms described below and known in the art.

"% identity" or percent identity" or "PID" refers to protein sequence identity. Percent identity may be determined using standard techniques known in the art. The percent amino acid identity shared by sequences of interest can be determined by aligning the sequences to directly compare the sequence information, e.g., by using a program such as BLAST, MUSCLE, or CLUSTAL. The BLAST algorithm is described, for example, in Altschul et al., J Mol Biol, 215:403-410 (1990) and Karlin et al., Proc Natl Acad Sci USA, 90:5873-5787 (1993). A percent (%) amino acid sequence identity value is determined by the number of matching identical residues divided by the total number of residues of the "reference" sequence including any gaps created by the program for optimal/maximum alignment. BLAST algorithms refer to the "reference" sequence as the "query" sequence.

As used herein, "homologous proteins" or "homologous proteases" refers to proteins that have distinct similarity in primary, secondary, and/or tertiary structure. Protein homology can refer to the similarity in linear amino acid sequence when proteins are aligned. Homology can be determined by amino acid sequence alignment, e.g., using a program such as BLAST, MUSCLE, or CLUSTAL. Homologous search of protein sequences can be done using BLASTP and PSI-BLAST from NCBI BLAST with threshold (E-value cut-off) at 0.001. (Altschul et al., "Gapped BLAST and PSI BLAST a new generation of protein database search programs". Nucleic Acids Res, Set 1:25(17):3389-402 (1997)). The BLAST program uses several search parameters, most of which are set to the default values. The NCBI BLAST algorithm finds the most relevant sequences in terms of biological similarity but is not recommended for query sequences of less than 20 residues (Altschul et al., Nucleic Acids Res, 25:3389-3402, 1997 and Schaffer et al., Nucleic Acids Res, 29:2994-3005, 2001). Exemplary default BLAST parameters for a nucleic acid sequence searches include: Neighboring words threshold=11: E-value cutoff=10; Scoring Matrix=NUC.3.1 (match=1, mismatch=−3); Gap Opening=5; and Gap Extension=2. Exemplary default BLAST parameters for amino acid sequence searches include: Word size=3; E-value cutoff=10; Scoring Matrix=BLOSUM62; Gap Opening=11; and Gap extension=1. Using this information, protein sequences can be grouped and/or a phylogenetic tree built therefrom. Amino acid sequences can be entered in a program such as the Vector NTI Advance suite and a Guide Tree can be created using the Neighbor Joining (NJ) method (Saitou and Nei, Mol Biol Evol, 4:406-425, 1987). The tree construction can be calculated using Kimura's correction for sequence distance and ignoring positions with gaps. A program such as AlignX can display the calculated distance values in parenthesis following the molecule name displayed on the phylogenetic tree.

Understanding the homology between molecules can reveal the evolutionary history of the molecules as well as information about their function; if a newly sequenced protein is homologous to an already characterized protein, there is a strong indication of the new protein's biochemical function. The most fundamental relationship between two entities is homology; two molecules are said to be homologous if they have been derived from a common ancestor. Homologous molecules, or homologs, can be divided into two classes, paralogs and orthologs. Paralogs are homologs that are present within one species. Paralogs often differ in their detailed biochemical functions. Orthologs are homologs that are present within different species and have very similar or identical functions. A protein superfamily is the largest grouping (clade) of proteins for which common ancestry can be inferred. Usually this common ancestry is based on sequence alignment and mechanistic similarity. Superfamilies typically contain several protein families which show sequence similarity within the family. The term "protein clan" is commonly used for protease superfamilies based on the MEROPS protease classification system.

The CLUSTAL W algorithm is another example of a sequence alignment algorithm (See, Thompson et al., Nucleic Acids Res, 22:4673-4680, 1994). Default parameters for the CLUSTAL W algorithm include: Gap opening penalty=10.0; Gap extension penalty=0.05; Protein weight matrix=BLOSUM series; DNA weight matrix=IUB; Delay divergent sequences %=40; Gap separation distance=8; DNA transitions weight=0.50; List hydrophilic residues=GPSNDQEKR; Use negative matrix=OFF; Toggle Residue specific penalties=ON; Toggle hydrophilic penalties=ON; and Toggle end gap separation penalty=OFF. In CLUSTAL algorithms, deletions occurring at either terminus are included. For example, a variant with a five amino acid deletion at either terminus (or within the polypeptide) of a polypeptide of 500 amino acids would have a percent sequence identity of 99% (495/500 identical residues×100) relative to the "reference" polypeptide. Such a variant would be encompassed by a variant having "at least 99% sequence identity" to the polypeptide.

A nucleic acid or polynucleotide is "isolated" when it is at least partially or completely separated from other components, including but not limited to for example, other proteins, nucleic acids, cells, etc. Similarly, a polypeptide, protein or peptide is "isolated" when it is at least partially or completely separated from other components, including but not limited to for example, other proteins, nucleic acids, cells, etc. On a molar basis, an isolated species is more abundant than are other species in a composition. For example, an isolated species may comprise at least about 60%, about 65%, about 70%, about 75%, about 80%, about 85%, about 90%, about 91%, about 92%, about 93%, about 94%, about 95%, about 96%, about 97%, about 98%, about 99%, or about 100% (on a molar basis) of all macromolecular species present. Preferably, the species of interest is purified to essential homogeneity (i.e., contaminant species cannot be detected in the composition by conventional detection methods). Purity and homogeneity can be determined using a number of techniques well known in the art, such as agarose or polyacrylamide gel electrophoresis of a nucleic acid or a protein sample, respectively, followed by visualization upon staining. If desired, a high-resolution technique, such as high performance liquid chromatography (HPLC) or a similar means can be utilized for purification of the material.

The term "purified" as applied to nucleic acids or polypeptides generally denotes a nucleic acid or polypeptide that is essentially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or polypeptide is at least about 50% pure, usually at least about 60%, about 65%, about 70%, about 75%, about 80%, about 85%, about 90%, about 91%, about 92%, about 93%, about 94%, about 95%, about 96%, about 97%, about 98%, about 99%, about 99.5%, about 99.6%, about 99.7%, about 99.8% or more pure (e.g., percent by weight on a molar basis). In a related sense, a composition is enriched for a molecule when there is a substantial increase in the concentration of the molecule after application of a purification or enrichment technique. The term "enriched" refers to a compound, polypeptide, cell, nucleic acid, amino acid, or other specified material or component that is present in a composition at a relative or absolute concentration that is higher than a starting composition.

As used herein, the term "functional assay" refers to an assay that provides an indication of a protein's activity. In some embodiments, the term refers to assay systems in which a protein is analyzed for its ability to function in its usual capacity. For example, in the case of a protease, a functional assay involves determining the effectiveness of the protease to hydrolyze a proteinaceous substrate.

The term "cleaning activity" refers to a cleaning performance achieved by a serine protease polypeptide or reference subtilisin under conditions prevailing during the proteolytic, hydrolyzing, cleaning, or other process of the disclosure. In some embodiments, cleaning performance of a serine protease or reference subtilisin may be determined by using various assays for cleaning one or more enzyme sensitive stain on an item or surface (e.g., a stain resulting from food, grass, blood, ink, milk, oil, and/or egg protein). Cleaning performance of one or more subtilisin variant described herein or reference subtilisin can be determined by subjecting the stain on the item or surface to standard wash condition(s) and assessing the degree to which the stain is removed by using various chromatographic, spectrophotometric, or other quantitative methodologies. Exemplary cleaning assays and methods are known in the art and include, but are not limited to those described in WO99/3401 and U.S. Pat. No. 6,605,458, as well as those cleaning assays and methods included in the Examples provided below.

The term "cleaning effective amount" of one or more subtilisin variant described herein or reference subtilisin refers to the amount of protease that achieves a desired level of enzymatic activity in a specific cleaning composition. Such effective amounts are readily ascertained by one of ordinary skill in the art and are based on many factors, such as the particular protease used, the cleaning application, the specific composition of the cleaning composition, and whether a liquid or dry (e.g., granular, tablet, bar) composition is required, etc.

The term "cleaning adjunct material" refers to any liquid, solid, or gaseous material included in cleaning composition other than one or more subtilisin variant described herein, or recombinant polypeptide or active fragment thereof. In some embodiments, the cleaning compositions of the present disclosure include one or more cleaning adjunct materials. Each cleaning adjunct material is typically selected depending on the particular type and form of cleaning composition (e.g., liquid, granule, powder, bar, paste, spray, tablet, gel, foam, or other composition). Preferably, each cleaning adjunct material is compatible with the protease enzyme used in the composition.

Cleaning compositions and cleaning formulations include any composition that is suited for cleaning, bleaching, disinfecting, and/or sterilizing any object, item, and/or surface. Such compositions and formulations include, but are not limited to for example, liquid and/or solid compositions, including cleaning or detergent compositions (e.g., liquid, tablet, gel, bar, granule, and/or solid laundry cleaning or detergent compositions and fine fabric detergent compositions, hard surface cleaning compositions and formulations, such as for glass, wood, ceramic and metal counter tops and windows; carpet cleaners; oven cleaners; fabric fresheners: fabric softeners; and textile, laundry booster cleaning or detergent compositions, laundry additive cleaning compositions, and laundry pre-spotter cleaning compositions; dishwashing compositions, including hand or manual dishwashing compositions (e.g., "hand" or "manual" dishwashing detergents) and automatic dishwashing compositions (e.g., "automatic dishwashing detergents"). Single dosage unit forms also find use with the present invention, including but not limited to pills, tablets, gelcaps, or other single dosage units such as pre-measured powders or liquids.

Cleaning composition or cleaning formulations, as used herein, include, unless otherwise indicated, granular or powder-form all-purpose or heavy-duty washing agents, especially cleaning detergents; liquid, granular, gel, solid, tablet, paste, or unit dosage form all-purpose washing agents, especially the so-called heavy-duty liquid (HDL) detergent or heavy-duty dry (HDD) detergent types: liquid fine-fabric detergents; hand or manual dishwashing agents, including those of the high-foaming type; hand or manual dishwashing, automatic dishwashing, or dishware or tableware washing agents, including the various tablet, powder, solid, granular, liquid, gel, and rinse-aid types for household and institutional use; liquid cleaning and disinfecting agents, including antibacterial hand-wash types, cleaning bars, mouthwashes, denture cleaners, car shampoos, carpet shampoos, bathroom cleaners; hair shampoos and/or hair-rinses for humans and other animals; shower gels and foam baths and metal cleaners: as well as cleaning auxiliaries, such as bleach additives and "stain-stick" or pre-treat types. In some embodiments, granular compositions are in "compact" form; in some embodiments, liquid compositions are in a "concentrated" form.

As used herein, "fabric cleaning compositions" include hand and machine laundry detergent compositions including laundry additive compositions and compositions suitable for use in the soaking and/or pretreatment of stained fabrics (e.g., clothes, linens, and other textile materials).

As used herein, "non-fabric cleaning compositions" include non-textile (i.e., non-fabric) surface cleaning compositions, including, but not limited to for example, hand or manual or automatic dishwashing detergent compositions, oral cleaning compositions, denture cleaning compositions, contact lens cleaning compositions, wound debridement compositions, and personal cleansing compositions.

As used herein, the term "detergent composition" or "detergent formulation" is used in reference to a composition intended for use in a wash medium for the cleaning of soiled or dirty objects, including particular fabric and/or non-fabric objects or items. In some embodiments, the detergents of the disclosure comprise one or more subtilisin variant described herein and, in addition, one or more surfactants, transferase(s), hydrolytic enzymes, oxido reductases, builders (e.g., a builder salt), bleaching agents, bleach activators, bluing agents, fluorescent dyes, caking inhibitors, masking agents, enzyme activators, antioxidants, and/or solubilizers. In some instances, a builder salt is a mixture of a silicate salt and a phosphate salt, preferably with more silicate (e.g., sodium metasilicate) than phosphate (e.g., sodium tripolyphosphate). Some embodiments are directed to cleaning compositions or detergent compositions that do not contain any phosphate (e.g., phosphate salt or phosphate builder).

As used herein, the term "bleaching" refers to the treatment of a material (e.g., fabric, laundry, pulp, etc.) or surface for a sufficient length of time and/or under appropriate pH and/or temperature conditions to effect a brightening (i.e., whitening) and/or cleaning of the material. Examples of chemicals suitable for bleaching include, but are not limited to, for example, $ClO_2$, $H_2O_2$, peracids, $NO_2$, etc.

As used herein, "wash performance" of a protease (e.g., one or more subtilisin variant described herein, or recombinant polypeptide or active fragment thereof) refers to the contribution of one or more subtilisin variant described herein to washing that provides additional cleaning performance to the detergent as compared to the detergent without the addition of the one or more subtilisin variant described herein to the composition. Wash performance is compared under relevant washing conditions. In some test systems, other relevant factors, such as detergent composition, sud concentration, water hardness, washing mechanics, time, pH, and/or temperature, can be controlled in such a way that condition(s) typical for household application in a certain market segment (e.g., hand or manual dishwashing, automatic dishwashing, dishware cleaning, tableware cleaning, fabric cleaning, etc.) are imitated.

The term "relevant washing conditions" is used herein to indicate the conditions, particularly washing temperature, time, washing mechanics, sud concentration, type of detergent and water hardness, actually used in households in a hand dishwashing, automatic dishwashing, or laundry detergent market segment.

As used herein, the term "disinfecting" refers to the removal of contaminants from the surfaces, as well as the inhibition or killing of microbes on the surfaces of items.

The "compact" form of the cleaning compositions herein is best reflected by density and, in terms of composition, by the amount of inorganic filler salt. Inorganic filler salts are conventional ingredients of detergent compositions in powder form. In conventional detergent compositions, the filler salts are present in substantial amounts, typically about 17 to about 35% by weight of the total composition. In contrast, in compact compositions, the filler salt is present in amounts not exceeding about 15% of the total composition. In some embodiments, the filler salt is present in amounts that do not exceed about 10%, or more preferably, about 5%, by weight of the composition. In some embodiments, the inorganic filler salts are selected from the alkali and alkaline-earth-metal salts of sulfates and chlorides. In some embodiments, the filler salt is sodium sulfate.

Disclosed herein is one or more subtilisin variant useful for cleaning applications and in methods of cleaning, as well as in a variety of industrial applications. Disclosed herein is one or more isolated, recombinant, substantially pure, or non-naturally occurring subtilisin variant. In some embodiments, one or more subtilisin variant described herein is useful in cleaning applications and can be incorporated into cleaning compositions that are useful in methods of cleaning an item or a surface in need thereof.

One embodiment provides one or more subtilisin variant comprising two, three, or four or more variations versus SEQ ID NO:2 at positions selected from: (i) 1, 3, 9, 10, 15, 17, 19, 22, 24, 25, 26, 27, 28, 30, 35, 37, 38, 43, 45, 48, 68, 71, 74, 76, 77, 78, 86, 87, 91, 95, 96, 98, 99, 100, 102, 103, 108, 111, 114, 115, 120, 123, 125, 126, 127, 128, 129, 130, 136, 143, 146, 147, 151, 155, 160, 165, 183, 184, 187, 193, 202, 203, 210, 217, 234, 238, 239, 240, 242, 247, 250, 251, 255, 258, 259, 260, and 274; (ii) 1, 3, 9, 15, 22, 24, 28, 30, 35, 37, 45, 48, 68, 71, 74, 76, 77, 78.86, 87, 95, 96, 98.99, 100, 108, 114, 115, 120, 123, 125, 126.127, 128, 129, 130, 143, 146, 147, 151, 155, 165, 183.184, 187, 193, 202, 203, 210, 217, 234, 238, 239, 240, 242, 247, 250, 255, 258, 259, 260, and 274: (iii) 1, 3, 15, 35, 68, 71, 77, 86, 87, 95, 99, 115, 123, 127, 128, 147, 155, 165, 184, 202, 210, 217, 234, 239, 242, 250, 258, and 274; or (iv) 3, 68, 77, 86, 99, 115, 123, 127, 128, 165, 184, 202, 210, 217, and 258; with the proviso that one or more of said two, three, or four or more variations is a non-naturally occurring amino acid; wherein said variant has 85% or more amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2. Another embodiment is directed to one or more subtilisin variant comprising an amino acid sequence comprising two, three, or four or more variations at positions corresponding to SEQ ID NO:2, wherein said positions are selected from: (i) 1, 3, 9, 10, 15, 22, 24, 26, 27, 28, 29, 30, 31, 35, 37, 40, 43, 45, 48, 52, 68, 71, 76, 77, 78, 86, 87, 95, 96, 98, 99, 100, 101, 102, 103, 105, 108, 111, 114, 115, 117, 119, 123, 125, 126, 127, 128, 129, 130, 136, 143, 146, 147, 151, 155, 158, 160, 161, 165, 184, 187, 193, 202, 203, 204, 210, 211, 216, 217, 234, 238, 239, 242, 243, 250, 255, 258, 259, 260, 264, and 274: (ii) 1, 3, 9, 10, 15, 22, 24, 26, 28, 29, 30, 31, 35, 37, 40, 45, 48, 52, 68, 71, 76, 77, 78, 86, 87, 95, 96, 98, 99, 100, 101, 102, 105, 108, 111.114, 115.117, 119, 123, 125, 126, 127, 128, 129, 130, 136, 143, 146, 147, 151, 155, 158, 160, 161, 165, 184, 187, 193, 202, 203, 204, 210, 211, 216, 217, 234, 238, 239, 242, 243, 250, 255, 258, 259, 260, 264, and 274: (iii) 1, 3, 9, 10, 24, 26, 29, 30, 31, 35, 37, 40, 45, 48, 52, 68, 71, 77, 78, 86, 87, 95, 96, 98, 99, 100, 101, 102, 105, 108, 111, 115, 117, 119, 123, 127, 128, 129.130, 136.143, 146, 147, 151, 155, 158, 160, 161, 165.184, 187.193, 202, 203, 204, 210, 211, 216, 217, 234, 238, 239, 242, 243, 250, 258, 259, 260, 264, and 274; (iv) 3, 9, 10, 35, 68, 77, 78, 86, 87, 99, 101, 115, 123, 127, 128, 165, 184, 187, 202, 203, 210, 217, 242, 250, 258, and 264 or (v) 3, 68, 77, 78, 123, 127, 128, 165, 184, 202, 210, 217, and 258; with the proviso that one or more of said two, three, or four or more variations is a man-made mutation or substitution; wherein said variant has at least 85% but less than 100% amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

Still another embodiment provides one or more subtilisin comprising an amino acid sequence comprising two, three, or four or more amino acid variations versus SEQ ID NO:2 selected from: (i) 1Q, 3Q/V, 9E/T, 10M, 15I/V, 17H, 19E, 22Y, 24N, 25D, 26R. 27R, 28A, 30T, 35A, 37T, 38G, 43A, 45I/R, 48I, 68S, 71A, 74G, 76K, 77D/H/N/Q/S, 78I, 86H/N/R, 87S/T, 91G, 95A/Q, 96S, 98H/K/R, 99L/S, 100N/R, 102R, 103I, 108H/K, 111Q, 114N, 115F. 120A, 123I, 125N, 126Q, 127F/T, 128P/S, 129T, 130S, 136A/R, 143V, 146A/S, 147L, 151G, 155A/E/G, 160C/R, 165A/E/Q/S, 183A/G, 184Q, 187P, 193D, 202V, 203E/N, 210E/H/P, 217S, 234I/W, 238R/T, 239K/S/T, 240N, 242G, 247W, 250G, 251E, 255R. 258E/H/P, 259P, 260W, and 274A/F; (ii) 1Q, 3Q/V, 9E, 15I, 22Y, 24N, 28A. 30T, 35A, 37T. 45I, 48I, 68S, 71A, 74G, 76K, 77D/H/N/S, 78I, 86H/N/R, 87S/T, 95A/Q, 96S, 98K, 99L/S, 100N, 108H/K, 114N, 115F, 120A, 123I, 125N, 126Q, 127F/T, 128P/S, 129T, 130S, 143V, 146A/S, 147L, 151G, 155A/E/G, 165A/E/Q/S, 183G, 184Q, 187P, 193D, 202V, 203E/N, 210P, 217S, 234I/W, 238R/T, 239K/S/T, 240N, 242G, 247W, 250G, 255R, 258P, 259P, 260W, and 274A; (iii) 1Q, 3V, 15I, 35A, 68S, 71A, 77N, 86H, 87S, 95A, 99S, 115F, 123I, 127T, 128P/S. 147L. 155G, 165Q/S. 184Q, 202V, 210P, 217S, 234W, 239S, 242G, 250G, 258P, and 274A; or (iv) 3V, 68S, 77N, 86, 99S, 115F, 123I, 127T, 128P, 165Q, 184Q, 202V, 210P, 217S, and 258P; with the proviso that one or more of said two, three, or four or more variations is a non-naturally occurring amino acid; wherein said variant has 85% or more amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

Yet another embodiment provides one or more subtilisin variant comprising an amino acid sequence comprising two, three, or four or more amino acid substitutions selected from: (i) A/G1, T3, P9, L/Q10, K15, HQ17, Q19, K22, A24, N25, V26, K27, G/V28, I/V30, I35, A/S/T37, S38, N/K43, V45, A48, A68, V71, L74, N76, S/T77, I/T78, N/S86, V87, A/I91. L95, N96, S98, G99, S100. S/T102, Y103, S108, E111, T114, A/Q/T115, V120, M123, L125, G126, G127, A/P/T128. S129, G/V130, Q136, A/S143, A/I/V146, V147, A/S151, S155, N/S/Y160, G165, G/K/N/S183, N/Q184, S187, A/P/S193, K194, A/S/V202, G/S203, S/T210, S211, N217, L234, P238, A/N/T239, A242, D/N/T247, S250, R/S251, N/Y255. D/S258, S259, F260, and Q274; (ii) A/G1, T3, P9, K15. K22, A24, G/V28, I/V30, I35, A/S/T37, V45, A48, A68, V71, L74, N76, S/T77, I/T78, N/S86, V87, L95, N96. S98, G99, S100, S108, T114, A/Q/T115, V120, M123, L125, G126, G127, A/P/T128, S129, G/V130, A/S143, A/I/V146, V147, A/S151, S155, G165, K/S183, N184, S187, A/P/S193, K194, A/S/V202, G/S203, S/T210, S211, N217, L234, P238, A/N/T239, A242, D/N/T247, S250, N/Y255, D/S258, S259, F260, and Q274; (iii) A/G1, T3, K15, I35, A68, V71, S/T77, N/S86, V87. L95. G99, A/Q/T115, M123, G127, A/P/T128. V147, S155, G165, N184, A/S/V202, S/T210, N217, L234, A/N/T239, A242, S250, D/S258, and Q274; or (iv) T3, A68, S/T77, N/S86, G99, A/Q/T115, M123, G127, A/P/T128, G165, N184, A/S/V202, S/T210, N217, and D/S258; with the proviso that one or more of said two, three, or four or more substitutions is a non-naturally occurring amino acid; wherein said variant has 85% or more amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2. Yet still another embodiment provides one or more subtilisin variant comprising an amino acid sequence comprising two, three, or four or more amino acid substitutions selected from: (i) A/G1, T3, P9, L10, K15, H/Q17, Q19, K22, A24, N25, V26, K27, G/V28, I/V30, I35, A/S/T37, S38, N/K43, V45, A48, A68, V71, L74, N76, T77, T78, N/S86, V87, A91, L95, N96, S98, G99, S100, S/T102, Y103, S108, E111, T114, Q/T115, V120, M123, L125, G126, G127, A/P128, S129, G/V130, Q136, A143, A/I/V146, V147. A/S151, S155, N/S160, G165, K/S183, N184, S187, A/S193, K194, A/V202, G/S203, S/T210, S211, N217, L234, P238, N/T239, A242, N/T247, S250, R/S251, N/Y255, D/S258, S259, F260, and Q274: (ii) A/G1, T3, P9, K15, K22, A24, G/V28, i/V30, 13S, A/S/T37, V45, A48, A68, V71, L74, N76, T77, T78, N/S86, V87, L95. N96, S98, G99, S100. S108, T14, Q/T115, V120, M123, L125, G126, G127, A/P128, S129, G/V130, A143, A/I/V146, V147, A/S151, S155, G165, K/S183, N184, S187, A/S193, K194, A/V202, G/S203, S/T210, S211, N217, L234, P238, N/T239, A242, N/T247, S250, N/Y255, D/S258, S259, F260, and Q274: (iii) A/G1, T3, K15, 13S, A68, V71, T77, N/S86, V87, L95, G99, Q/T115, M123, G127, A/P128, V147, S155, G165. N184, A/V202, S/T210, N217, L234, N/T239. A242, S250, D/S258, and Q274; or (iv) T3, A68, T77, N/S86, G99, Q/T115, M123, G127, A/P128, G165, N184, A/V202, S/T210, N217, and D/S258; with the proviso that one or more of said two, three, or four or more substitutions is a non-naturally occurring amino acid; wherein said variant has 85% or more amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

A further embodiment provides one or more subtilisin variant comprising an amino acid sequence comprising two, three, or four or more amino acid substitutions selected from: (i) 1Q, 3Q/V, 9E/T, 10M, 15I/V, 17H, 19E, 22Y, 24N, 25D, 26R. 27R, 28A, 30T, 35A, 37T, 38G, 43A, 45R, 48I, 68S, 71A, 74G, 76K, 77D/H/N/Q/S, 78I, 86H/N/R/S, 87S/T, 91G, 95A/Q, 96S, 98H/K/R. 99L/S, 100N/R, 102R, 103I, 108H/K, 111Q, 114N, 115F. 120A, 123I, 125N, 126Q, 127F/T, 128P/S, 129T, 130S, 136A/R, 143V, 146A/S, 147L, 151G, 155A/E/G, 160C/R, 165A/E/Q/S, 183A/G, 184Q, 187P, 193D, 194E, 202V, 203E/N, 210E/H/P, 211N, 217S, 234I/W, 238R/T, 239K/S/T, 242G, 247W, 250G, 251E, 255R, 258E/H/P, 259P, 260W, and 274A/F; (ii) 1Q, 3Q/V, 9E, 15I, 22Y, 24N, 28A, 30T, 35A, 37T, 45I, 48I, 68S, 71A, 74G. 76K, 77D/H/N/S, 78, 86H/N/R/S, 87S/T, 95A/Q, 96S. 98K, 99L/S, 100N, 108H/K, 114N, 115F, 120A, 123I, 125N, 126Q127F/T, 128P/S, 129T, 130S, 143V, 146A/S, 147L, 151G, 155A/E/G, 165A/E/Q/S, 183G, 184Q, 187P, 193D, 194E, 202V, 203E/N, 210P, 211N, 217S, 234I/W, 238R, 239K/S/T. 242G, 247W, 250G, 255R, 258P, 259P, 260W, and 274A: (iii) 1Q, 3V, 15I, 35A, 68S, 71A. 77N, 86H, 87S, 95A, 99S, 115F, 123I, 127T, 128P/S. 147L. 155G, 165Q/S. 184Q, 202V, 210P, 217S, 234W, 239S, 242G, 250G, 258P, and 274A; or (iv) 3V, 68S, 77N, 86, 99S, 115F, 123I, 127T, 128P, 165Q, 184Q, 202V, 210P, 217S, and 258P; with the proviso that one or more of said two, three, or four or more substitutions is a non-naturally occurring amino acid; wherein said variant has 85% or more amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

Yet a further embodiment is directed to one or more subtilisin variant comprising an amino acid sequence comprising two, three, or four or more amino acid substitutions at two, three, or four or more positions corresponding to SEQ ID NO:2, wherein said substitutions are selected from: (i) 1Q, 3Q/V, 9E, 10M, 15I, 22Y, 24N/Q, 26Q, 27R, 28A, 29S, 30T, 31I, 35A. 37T, 40E, 43A, 45I/Q/R, 48I/T/V, 52R, 68S, 71A, 76K, 77D/E/H/N/Q/S, 78I, 86H/N/R, 87S/T, 95A/F/Q, % S, 98H/R, 99A/E/Q/S, 100N, 101A, 102D/T, 103I, 105N, 108H/K, 11Q, 114N, 115F, 117S, 119Q, 123I, 125N, 126Q, 127E/F/Q/S/T/V, 128P/R/S, 129H/R, 130S, 136N/R. 143Q/V, 146A/S, 147L, 151G, 155E/G/N, 158D/N/Q, 160C/D/K, 161D/Q, 165A/E/Q/S, 184E/Q, 187E/P, 193D/Q, 202V, 203E/N/Q, 204I, 210E/H/I/P, 21S, 216Q, 217S. 234I/W, 238Q/R, 239K/S/T, 242G/N, 243I, 250G, 255R, 258D/E/P. 259E/P, 260W, 264H/Q/S, and 274A; (ii) 1Q, 3Q/V, 9E, 10M, 151, 22Y, 24N/Q, 26Q, 28A, 29S, 30T, 31I, 35A. 37T, 40E, 45I/Q/R, 48/T/V, 52R, 68S, 71A, 76K, 77D/E/H/N/S, 78I, 86H/N/R, 87S/T, 95A/F/Q, 96S, 98K/R. 99A/E/Q/S, 100N, 101A, 102D/T, 105N, 108H/K, 111Q, 114N, 115F, 117S, 119Q, 123I, 125N, 126Q127E/F/Q/S/T/V, 128P/R/S, 129H/R, 130S, 136N. 143Q/V, 146A/S, 147L, 151G, 155E/G/N, 158D/N/Q, 160D/K, 161D/Q, 165A/E/Q/S, 184E/Q, 187E/P. 193D/Q, 194E, 202V, 203E/N/Q, 204I, 210I/P, 211S, 216Q217S, 234I/W, 238Q/R, 239K/S/T, 242G/N, 243I, 250G, 255R, 258D/P, 259E/P, 260W, 264H/Q/S, and 274A; (iii) 1Q, 3V, 9E, 10M, 24Q, 26Q, 29S, 30T, 31I, 35A, 37T, 40E, 45I/Q/R, 48T/V, 52R, 68S, 71A, 77E/N, 78I, 86H/R, 87S, 95A/F, 96S, 98R. 99A/E/Q/S, 100N, 101A, 102D/T, 105N, 108H, 111Q, 115F. 117S, 119Q, 123I, 127E/Q/S/T/V, 128P/R. 129H/R. 130S, 136N, 143Q/V, 146A, 147L, 151G, 155G/N, 158D/N/Q, 160D/K, 161D/Q, 165A/E/Q, 184E/Q, 187E/P, 193Q, 202V, 203E/N/Q, 204I, 210/P, 211 S, 216Q, 217S, 234W, 238Q, 239S, 242G/N, 243I, 250G, 258D/P, 259E/P, 260W, 264H/Q/S, and 274A; (iv) 3V, 9E, 10M, 35A, 68S, 77N, 781, 86H, 87S, 99Q/S, 101A, 115F. 123I, 127S/T, 128P/R, 165E/Q, 184Q, 187E, 202V. 203E. 210P, 217S, 242G, 250G, 258D/P, and 264H: or (v) 3V, 68S. 77N, 78I, 123I, 127S, 128P, 165Q, 184Q, 202V, 210P, 217S. and 258D/P; with the proviso that one or more of said two, three, or four or more substitutions is a man-made substitution; wherein said variant has at least 85% but less than 100% amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

A still further embodiment provides one or more subtilisin variant comprising an amino acid sequence comprising two, three, or four or more amino acid substitutions selected from: (i) A/G1Q, T3Q/V, P9E/T, L/Q10M, K15I/V, Q17H, Q19E, K22Y, A24N, N25D, V26R K27R, G/V28A, I/V30T, I35A, A/S37T, S38G, N/K43A, V45I/R, A48I, A68S, V71A, L74G, N76K, S/T77D/H/N/Q/S, T78I, N/S86H/N/R/S, V87S/T, A/I91G, L95A/Q, N96S, S98H/K/R, G99L/S, S100N/R, S/T102R. Y103I, S108H/K, E1Q, T14N A/Q/ T115F, V120A, M123I, L125N, G126Q, G127F/T, A/P/ T128P/S, S129T. G/V130S, Q136A/R, A/S143V, A/I/ V146A/S, V147L, A/S151G, S155A/E/G, N/S/Y160C/R, G165A/E/Q/S, G/K/N/S183A/G, N184Q, S187P, A/P/ S193D, K194E, A/S202V, G/S203E/N, S/T210E/H/P, S211N, N217S, L234I/W, P238R/T, A/N/T239K/S/r, A242G, D/N/T247W, S250G, R/S251E, N/Y255R, D/S258E/HP, S259P, F260W, and Q274A/F; (ii) A/G1Q, T3Q/V, P9E, K15I, K22Y, A24N, G/V28A, I/V30T78I, N/S86H/N/R/S, V87S/T, L95A/Q, N96S, S98K, G99L/S, S100N, S108H/K, T114N. A/Q/T115F, V120A, M123, L125N, G126Q, G127F/T, A/P/T128P/S, S129T, G/V130S, A/S143V, A/I/V146A/S, V147L, A/S151G, S155A/E/G, G165A/E/Q/S, K/S183G, N184Q. S187P. A/P/S193D, K194E, A/S202V, G/S203E/N, S/T210P, S211N, N217S, L234I/W, P238R/T, A/N/T239K/S/T, A242G, D/N/T247W, S250G, N/Y255R/D/S258P, S259P, F260W, and Q274A; (iii) A/G1Q, T3V, K15I, I35A, A68S, V71A. S/T77N, N/S86H, V87S, L95A, G99S, A/Q/T115F, M123I, G127T, A/P/T128P/S, V147L, S155G, G165Q/S, N184Q. A/S202V, S/T210P, N217S, L234W, A/N/T239S, A242G, S250G, D/S258P, and Q274A; or (iv) T3V, A68S, S77N, N/S86H, G99S, A/Q/T115F. M123I, G127I, A/T128P, G165Q, N184Q, A/S202V, S/T210P, N217S, and D/S258P; with the proviso that one or more of said two, three, or four or more substitutions is a non-naturally occurring amino acid; wherein said variant has 85% or more amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2. Yet still a further embodiment provides one or more subtilisin variant comprising an amino acid sequence comprising two, three, or four or more amino acid substitutions selected from: (i) A/G1Q, T3Q/V, P9E/T, L10M. K15I/V, Q17H, Q19E, K22Y, A24N, N25D, V26R, K27R, G/V28A, I/V30T, I35A, A/S37T, S38G, N/K43A, V45/R, A48I, A68S, V71A, L74G, N76K, T77D/H/N/Q/S, T78I, N/S86H/N/R/S, V87S/T, A91G, L95A/Q, N96S, S98H/K/R, G99L/S, S100N/R, ST102R, Y103I, S108H/K, E111Q, T114N, Q/T115F, V120A, M123I, L125N, G126Q, G127F/T, A/P128P/S, S129T, G/V130S, Q136A/R, A143V, A/I/V146A/S, V147L, A/S151G, S155A/E/G, N/S160C/R, G165A/E/Q/S, K/S183A/G, N184Q, S187P, A/S193D, K194E, A202V, G/S203E/N, S/T210E/H/P, S211N, N217S, L234/W, P238R/T, N/T239K/S/T, A242G, I/T247W, S250G, R/S251E, N/Y255R, D/S258E/H/P, S259P, F260W, and Q274A/F; (ii) A/G1Q, T3Q/V, P9E, K15I, K22Y, A24N, G/V28A, I/V30T, I35A, A/S37T, V45I, A48I, A68S, V71A, L74G, N76K, T77D/H/N/S, T78I, N/S86H/N/R/S, V87S/T, L95A/Q, N96S, S98K, G99S, S100N, S108H/K, T114N, Q/T115F, V120A, M123I, L125N, G126Q, G127F/T, A/P128P/S, S129T, G/V130S, A143V, A/I/V146A/S, V147L, A/S151G, S155A/E/G, G165A/E/Q/S, K/S183G, N184Q, S187P, A/S193D, K194E, A202V, G/S203E/N. S/T210P. S211N, N217S, L234I/W, P238R/T. V/T239K/S/T, A242G, N/T247W, S250G, N/Y255R, D/S258P, S259P, F260W, and Q274A; (iii) A/G1Q, T3V, K15I, I35A, A68S, V71A, T77N, N/S86H, V87S, L95A, G99S, Q/T115F, M123I, G127I, A/P128P/S, V147L, S155G, G165Q/S, N184Q, A202V, S/T210P, N217S, L234W, N/T239S, A242G, S250G, D/S258P, and Q274A; or (iv) T3V, A68S, T77N, N/S86H, G99S, Q/T115F. M123, G127T, A128P, G165Q. N184Q, A202V, S/T210P, N217S, and D/S258P; with the proviso that one or more of said two, three, or four or more substitutions is a non-naturally occurring amino acid; wherein said variant has 85% or more amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

An even further embodiment is directed to one or more subtilisin variant comprising an amino acid sequence comprising two, three, or four or more amino acid substitutions selected from: (i) A/G1Q, T3Q/V, P/S9E, L/Q10M, K15I, K22Y, A24N/Q, V26Q, K27R. G/V28A, A/G29S, I/V30T, I/L31I, I35A, A/S37T, P/S/T40E, N/K43A, S/V45I/Q/R, A48I/T/V, A/S52R, A68S, V71A, N76K, S/T77D/E/H/N/Q/ S, T78I, N/S86H/N/R, V87S/T, L95A/F/Q, N96S, S98H/R, G99A/E/Q/S, S100N, G101A, S/T102D/T, Y103I, A/G105N, S108H/K, E111Q, T114N, A/Q/S/T115F. G/N117S, D119Q, M123I, L125N, G126Q, G127E/F/Q/S/ T/V, A/P/S128P/R/S, S129H/R, G/V130S, Q136N/R, A/S143Q/V, A/I/V146A/S, V147L, A/S151G, S155E/G/N, S158D/N/Q, N/S/Y160C/D/K, A/S/Q161D/Q, G165A/E/Q/ S, N/Q184E/Q, S187E/P, A/P/S193D/Q, A/S202V, A/G/ S203E/N/Q, V204I, S/T210E/H/I/P, N211S, L216Q, N217S, L234I/W, P238Q/R, A/N/T239K/S/T, A242G/N, S243I, S250G, N/Y255R, D/S258D/E/P, S259E/P, F260W, K/N/R264H/Q/S, and Q274A; (ii) A1Q. T3Q/V, P9E, L10M, K15I, K22Y, A24N/Q, V26Q, K27R, V28A, A29S, V30T, L31I, 35A, A37T, P40E, N43A, V45I/Q/R, A48I/T/V, A52R. A68S, V71A, N76K, S77D/E/H/N/Q/S, T78I, S86H/ N/R, V87S/T, L95A/F/Q, N96S, S98H/R. G99A/F/Q/S, S100N, G10A, S102D/T, Y103I, G15N. S108H/K, E111Q, T114N. T115F. G117S, D119Q, M123I, L125N, G126Q, G127E/F/Q/S/T/V, A128P/R/S, S129H/R, G130S, Q136N/ R, A143Q/V, V146A/S, V147L, A151G, S155E/G/N, S158D/N/Q, N160C/D/K T161D/Q, G165A/E/Q/S, N184E/ Q, S187E/P, A193D/Q, A202V, G203E/N/Q, V204I, T210E/ H/P, N211S, L216Q, N217S, L234I/W, P238Q/R, N239K/ S/T, A242G/N, S243I, S250G, Y255R, S258D/E/P, S259E/ P, F260W, K264H/Q/S, and Q274A; (iii) A/G/Q, T3Q/V, P/S9E. L/Q10M. K15I, K22Y, A24N/Q. V26Q, G/V28A, A/G29S, I/V30T, I/L31I, I35A, A/S37T, P/S/T40E, S/V45I/ Q/R, A48I/T/V, A/S52R. A68S, V71A, N76K, S/T77D/E/ H/N/S, T78I, N/S86H/N/R, V87S/T, L95A/F/Q, N96S, S98R. G99A/E/Q/S, S100N, G101A, S/T102D/T, A/G105N, S108H/K, E111Q, T114N, A/Q/S/T115F, G/N117S, D19Q, M123I, L125N, G126Q, G127E/F/Q/S/TV, A/P/S128P/R/S, S129H/R, G/V130S, Q136N, A/S143Q/V, A/I/V146A/S, V147L, A/S151G, S155E/G/N, S158D/N/Q, N/S/Y160D/K, A/S/Q/T161D/Q, G165A/E/Q/S, N/Q184E/Q, S187E/P, A/P/S193D/Q, A/S202V, A/G/S203E/N/Q, V204I, S/T210I/ P, N211S, L216Q, N217S, L234I/W, P238Q/R. A/N/T239K/ S/T, A242G/N, S243I, S250G, N/Y255R, D/S258D/P, S259E/P, F260W, K/N/R264H/Q/S, and Q274A; (iv) A1Q, T3Q/V, P9E, L10M, K15I, K22Y, A24N/Q, V26Q, V28A, A29S, V30T, L31I, I35A, A37T, P40E, V45I/Q/R, A48I/T/ V, A52R, A68S, V71A, N76K, T77D/E/H/N/S, T78I, S86H/ N/R. V87S/T, L95A/F/Q, N96S, S98R, G99A/E/Q/S, S100N, G101A, S102D/T, G105N, S108H/K, E111Q, T114N, T115F, G1I17S, D119Q, M123I, L125N, G126Q, G127E/F/Q/S/T/V, A128P/R/S, S29H/R, G130S, Q136N, A143Q/V, V146A/S, V147L, A151G, S155E/G/N, S158D/

N/Q, N160D/K, T161D/Q, G165A/E/Q/S, N184E/Q, S187E/P, A193D/Q, A202V, G203E/N/Q, V204I, T210I/P, N211 S, L216Q, N217S, L234/W, P238Q/R, N239K/S/T, A242G/N, S243I, S250G, Y255R, S258D/P, S259E/P, F260W, K264H/Q/S, and Q274A: (v) A/G1Q, T3V, P/S9E, L/Q10M, A24Q, V26Q, A/G29S, I/V30T, I/L3I, I35A, A/S37T, P/S/T40E, S/V45I/Q/R, A48T/V, A/S52R, A68S, V71A, S/T77E/N, T78I, N/S86H/R, V87S, L95A/F, N96S, S98R. G99A/E/Q/S, S100N, G110A, S/T102D/T, A/G105N, S108H, E111Q, A/Q/S/T115F, G/N117S, D119Q, M123I, G127E/Q/S/T/V, A/P/S128P/R, S129H/R, G/V130S, Q136N, A/S143Q/V, A/I/V146A, V147L, A/S151G, S55G/N, S58D/N/Q, N/S/Y160D/K, A/S/Q/T161D/Q, G165A/E/Q, N184E/Q, S87E/P, A/P/S193Q. A/S202V, A/G/S203E/N/Q, V204I. S/T210I/P, N211 S, L216Q, N217S, L234W, P238Q, A/N/T239S, A242G/N, S243I, S250G, D/S258D/P, S259E/P, F260W, K/N/R264H/Q/S, and Q274A; (vi) A1Q, T3V, P9E, L10M, A24Q, V26Q, A29S, V30T, L311, I35A, A37T, P40E, V45I/Q/R. A48T/V, A52R. A68S, V71A, T77E/N, T78I, S86H/R, V87S, L95A/F, N96S, S98R, G99A/E/Q/S, S100N, G101A, S102D/T, G105N, S108H, E111Q, T115F, G117S, D119Q, M123I, G127E/Q/S/T/V, A128P/R, S129H/R, G13S, Q136N, A143Q/V, V146A, V147L, A151G, S155G/N, S158D/N/Q, N160D/K, T161D/Q, G165A/E/Q, N184E/Q, S187E/P, A193Q, A202V, G203E/N/Q, V2041, T210I/P, N211S, L216Q N217S, L234W, P238Q, N239S, A242G/N, S243I, S250G, S258D/P, S259E/P, F260W, K264H/Q/S, and Q274A; (vii) T3V, P/S9E, L/Q10M, I35A, A68S, S/T77N, T78I, N/S86H, V87S, G99Q/S, G101A, A/Q/S/T115F, M123I, G127S/T, A/P/S128P/R, G165E/Q, N184Q, S187E, A/S202V, A/G/S203E, S/T210P, N217S, A242G, S250G, D/S258D/P, and K/N/R264H; (viii) T3V, P9E, L10M, I35A, A68S, T77N, T78I, S86H, V87S, G99Q/S, G101A, T115F, M123I, G127S/T, A128P/R. G165E/Q, N184Q, S187E, A202V, G203E, T210P, N217S, A242G, S250G, S258D/P, and K264H; (ix) T3V, A68S, S/T77N, T78I, M123I, G127S, A/S128P. G165Q, N184Q, A/S202V. S/T210P, N217S, and D/S258D/P; or (x) T3V, A68S, T77N, T78I, M123I, G127S, A128P, G165Q, N184Q, A202V, T210P, N217S, and S258D/P; with the proviso that one or more of said two, three, or four or more substitutions is a man-made substitution; wherein said variant has at least 85% but less than 100% amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

A further embodiment is directed to one or more subtilisin variant comprising an amino acid sequence comprising one or more amino acid substitution sets selected from: (i) T77N-G165Q, T77N-N217S, G165Q-N217S, A68S-T77N, N184Q-N217S, A68S-G165Q, G165Q-N184Q, T77N-A128P, T77N-N184Q, A68S-N217S, A128P-N217S, A128P-G165Q, A68S-A128P, A68S-N184Q, A128P-N184Q, T3V-N217S, A202V-N217S, T3V-T77N, T3V-N184Q, N184Q-A202V. G165Q-A202V, M123I-G165Q, T3V-G165Q, T3V-A128P, T3V-A68S, T77N-A202V, M123I-N217S, A68S-A202V, M123I-N184Q, A128P-A202V, T77N-M123I, T3V-A202V, N217S-S258P, A68S-M123I, N184Q-S258P, G165Q-S258P, M123I-A128P, T77N-S258P, T3V-M123I, A128P-S258P, A202V-S258P, A68S-S258P, T3V-S258P, M123I-A202V. M123I-S258P, A68S-G127S, G127S-A128P, T77N-G127S, G127S-A202V, G127S-N184Q, G127S-N217S, G127S-G165Q, T3V-G127S, G127S-S258P. M123I-G127S, T77N-T210P, G165Q-T210P, T210P-N217S, A128P-T210P, A68S-T210P, N184Q-T210P, T210P-S258P, A202V-T210P, M123I-T210P, T3V-T210P, G127S-T210P, G127T-N184Q, G127T-N217S, V87S-G165Q, M123I-Q136R, A68S-0127T, G127T-A128P, T77N-V87S, G127T-G165Q, T77N-G127T, 178I-A202V, A68S-S258D, G165Q-S258D, 177N-S258D, T77N-T78I, T78I-G165Q, N184Q-S258D, N217S-S258D, P9E-M123, A128P-A242G, A202V-S258D, A68S-T78I, G165Q-A242G, T77N-A242G, T78I-A128P, T78I-G127S, P9E-G165Q, Q136R-G165Q, T78-N184Q, V87S-A128P, V87S-N217S, A68S-V87S, G127T-A202V, I35A-T77N, T3V-T78I, T78I-N217S, A68S-A242G, A68S-G99S, G99S-A128P, G99S-G165Q. I35A-G165Q, L10M-A202V, T3V-G127T, T77N-G99S. T78I-S258P, V45R-M123, V87S-M123, M123I-N239S, P9E-N184Q, S155G-G165Q, T78I-M123I, V45R-Q136R, V87S-A202V, A128P-S258D, I35A-A202V, M123I-G127T, M123I-S258D, N184Q-N239S, P9E-N217S, Q136R-S258E, S86H-S258P, T3V-A242G, T3V-S258D, G99S-N184Q, G99S-N217S, I35A-V87S, N217S-A242G, P9E-Q136R. G127T-S258P. I35A-A128P, I35A-A68S. I35A-N217S, L10M-M123I, P9E-S258P, P9E-T210P, P9E-T77N, S86H-A202V, S86H-G165Q, S86H-N184Q, T77N-S155G, T77N-V147L, T78I-T210P, V87S-S155G, A202V-A242G, A242G-S258P, A68S-G165E, G127S-A242G, G165E-N184Q, G165E-N217S, M123I-S258E, N184Q-A242G, S86H-T115F, T3V-G99S, V147L-G165Q, A128R-G165Q, A128R-S258D, A68S-A128R. A68S-V147L, G127S-S258D, G165E-A202V, G165Q-S258E, G165S-T210P, G203E-T210P, G99S-G127S, G99S-M123I, G99S-T210P, L10M-A128P, L10M-A68S, L10M-N184Q, L10M-N217S, L10M-S258P, L10M-T77N, M123I-A242G, M123I-G165E, M123I-S187P, N239S-S258P, P9E-A128P, P9E-A202V, P9E-A68S, P9E-V45R, Q136R-N184Q, Q136R-N239S, S86H-N217S, T115F-S258P, T20P-A242G, T3V-G165E, T3V-L10M, T3V-P9E. T77N-A128R, T77N-G165E, T78-A242G, V45R-G165Q, V87T-M123I, V87T-N184Q, V87T-N239S, V87T-Q136R, A68S-G101A, A68S-V71A, G101A-A128P, G101A-G165Q, G101A-S258P, G165A-N184Q, G165E-S258P, G99S-S258P, I35A-M123I, K151-G165S, K151-T210P, L10M-G127S, L10M-G165Q, Q136R-S187P, S187E-A202V, S187P-S258P, S250G-S258P, T115F-A202V, T115F-G165Q, T3V-G101A, T3V-I35A. T3V-V87S, T77N-G101A, T77N-G203E, T78-S258D, V71A-G165Q. V71A-T77N, V87S-S258P, V87S-V147L, A128P-G165E, A128P-S155G, A128P-V147L, A128R-A202V, A128R-N184Q, A128R-N217S, A1Q-S86H, A68S-G99Q, A68S-S155G, G101A-A202V, G101A-G127S, G101A-N184Q, G101A-N217S, G165Q-G203E, G165Q-N239S, G165S-N239S, G99Q-A 128P, G99Q-G165Q, G99Q-N184Q, G99Q-N217S, G99S-A242G, I35A-N184Q, I35A-T78I. I35A-V147L, L10M-T210P, L10M-T78I, M123I-G165S, N184Q-G203E, N184Q-S187P, N43A-M123, P9E-G127S, P9E-S258E, Q136R-S258P, T115F-N217S, T3V-S86H, T77H-M123I, T77H-N184Q, T77H-N239S, T77H-Q136R, T77H-V87T, T77N-G99Q, T77N-S250G, T78I-G99S, T78I-V87S, V146S-G165S, V146S-N239S, V146S-T20P, V45R-S258E, V87S-A242G, V87S-N184Q, A128S-T210P, A143V-A202V, A143V-G165Q. A143V-S258P, A1Q-N184Q, A1Q-S258P, A68S-G203E, A68S-S187E, A68S-T114N, G101A-M123 G101A-T210P, G165A-N217S, G165Q-S187P, G99Q-A202V, G99S-A202V, I35A-A242G, I35A-S258P, L10M-35A, L10M-V87S, M123I-A128R, M123I-V146S, N184Q-S187E, N217S-L234W, N239S-S250G, N43A-Q136R. N43A-V45R, P9E-N239S, P9E-V87T, S155G-

N217S, S187E-N217S, S86H-A143V, S86H-Q274A, S86H-S250G, T114N-A128P, T114N-G165Q, T114N-N184Q, T114N-N217S, T115F-A143V, T115F-N184Q, T210P-N239S, T210P-S250G, T3V-A128R, T3V-G99Q, T77H-G165Q, T77N-S187E, T77N-T114N, V147L-N217S, V45R-N184Q, V71A-N184Q, V71A-N217S, V71A-T210P, T77N-G165Q-N217S, A68S-T77N-G165Q, T77N-N184Q-N217S, A68S-T77N-N217S, T77N-A128P-G165Q, T77N-A128P-N217S, A68S-T77N-A128P, G165Q-N184Q-N217S. T77N-G165Q-N184Q, A68S-A128P-G165Q, A68S-G165Q-N217S, A128P-N184Q-N217S, A128P-G165Q-N217S, A68S-A128P-N217S, A68S-N184Q-N217S, A68S-T77N-N184Q, T77N-A128P-N184Q, A68S-G65Q-N184Q, A128P-G165Q-N184Q, A68S-A128P-N184Q, T3V-N184Q-N217S, T3V-T77N-N217S, N184Q-A202V-N217S, T3V-T77N-N184Q, T3V-A128P-N217S, T3V-T77N-A128P, G165Q-A202V-N217S, T3V-A128P-N184Q, T77N-A202V-N217S, T3V-G165Q-N217S, T3V-T77N-G165Q, T3V-A68S-N217S, T3V-A68S-T77N, A68S-A202V-N217S, T3V-G165Q-N184Q, A128P-A202V-N217S, G165Q-N184Q-A202V, T77N-G165Q-A202V, T77N-N184Q-A202V, T3V-A128P-G165Q, T3V-A68S-A128P, T3V-A68S-N184Q, A128P-N184Q-A202V, A68S-N184Q-A202V, A68S-T77N-A202V, T3V-A68S-G165Q, 177N-A128P-A202V, A128P-G165Q-A202V, A68S-A128P-A202V, A68S-G165Q-A202V, M123I-G165Q-N217S, M123I-N184Q-N217S, T77N-M123I-G165Q, T77N-M123I-N217S, T3V-A202V-N217S, M123I-G165Q-N184Q, T77N-M123I-N184Q, T3V-N184Q-A202V, A68S-M123I-N217S, T3V-T77N-A202V, T3V-A128P-A202V, T3V-G165Q-A202V, M123I-A 128P-N217S, T3V-A68S-A202V, A68S-M123I-N184Q, A68S-T77N-M123I, M123I-A128P-N184Q, T3V-M123I-N217S, T77N-M123I-A128P, A68S-M123I-G165Q, M123I-A128P-G165Q, A68S-M123I-A128P, N184Q-N217S-S258P, T3V-M123I-N184Q, T3V-M123I-G165Q, T3V-T77N-M123I, T77N-N217S-S258P, G165Q-N217S-S258P, T3V-A68S-M123I, T3V-M123I-A128P, T77N-N184Q-S258P, A128P-N184Q-S258P, A128P-N217S-S258P. T77N-A128P-S258P, T77N-G165Q-S258P, A202V-N217S-S258P, G165Q-N184Q-S258P, N184Q-A202V-S258P, A68S-A128P-S258P, A68S-N184Q-S258P, A68S-N217S-S258P, A68S-T77N-S258P, M123I-A202V-N217S, T3V-N217S-S258P, A128P-G165Q-S258P, G65Q-A202V-S258P, T3V-A128P-S258P, T3V-N184Q-S258P, A68S-G165Q-S258P, T3V-M123I-A202V, T3V-T77N-S258P, A128P-A202V-S258P, M123I-N184Q-A202V, T77N-A202V-S258P, A68S-A202V-S258P, M123I-G165Q-A202V, T77N-M123I-A202V, T3V-A68S-S258P, A68S-M123I-A202V, M123I-A128P-A202V, T3V-A202V-S258P, T3V-G165Q-S258P, A68S-G127S-A128P, A68S-T77N-G127S, T77N-G127S-A128P, A68S-G127S-A202V, A68S-G127S-N184Q, A68S-G127S-N217S, G127S-A128P-A202V, G127S-A128P-N184Q, G127S-A128P-N217S, A68S-G27S-G165Q, G127S-A128P-G165Q, G127S-A202V-N217S, G127S-N184Q-A202V, G127S-N184Q-N217S, M123I-N217S-S258P, T77N-G127S-A202V, T77N-G127S-N184Q, T77N-G127S-N217S, M123I-N184Q-S258P, T77N-G127S-G165Q, T3V-A68S-G127S, T3V-G127S-A128P, G127S-G165Q-A202V, G127S-G165Q-N184Q, G127S-G165Q-N217S, M123I-A202V-S258P, M123-G165Q-S258P, T3V-M123I-S258P, T3V-T77N-G127S, A68S-G127S-S258P, G127S-A128P-S258P. A68S-M123I-S258P, M123I-A128P-S258P, T3V-G127S-A202V, T3V-G127S-N184Q, T3V-G127S-N217S, T77N-M123I-S258P, T3V-G127S-G165Q, T77N-G127S-S258P, G127S-A202V-S258P, G127S-N184Q-S258P, G127S-N217S-S258P, T3V-G27S-S258P, G127S-G165Q-S258P, A68S-M231-G127S, M123I-G127S-A128P, M123I-G127S-A202V, M123I-G127S-N184Q, M123I-G127S-N217S, T77N-M123I-G127S, T3V-M123I-G127S, M123I-G127S-G165Q, M123I-G127S-S258P, T77N-G165Q-T210P, A68S-T77N-T210P, A68S-G165Q-T210P, A68S-A128P-T210P, T77N-A128P-T210P, T77N-T210P-N217S, A68S-N184Q-T210P, N184Q-T210P-N217S, T77N-N184Q-T210P, A128P-G165Q-T210P, A68S-T210P-N217S, G165Q-N184Q-T210P, G165Q-T210P-N217S, A128P-N184Q-T210P, A128P-T210P-N217S, T77N-T210P-S258P, G165Q-T210P-S258P, T3V-A128P-T210P, T3V-A68S-T210P, T3V-T77N-T21P, A128P-T210P-S258P, A202V-T210P-N217S, A68S-T210P-S258P, N184Q-A202V-T210P, T210P-N217S-S258P, T3V-G165Q-T210P, T77N-A202V-T210P, A202V-T210P-S258P, G165Q-A202V-T210P, T3V-N184Q-T210P, A128P-A202V-T210P, A68S-A202V-T210P, N184Q-T210P-S258P, T3V-A202V-T210P, T3V-T210P-N217S, T3V-T210P-S258P, M123I-T210P-N217S, T77N-M123I-T210P, A68S-M123I-T210P, M123I-A128P-T210P, M123I-N184Q-T210P, A68S-G127S-T210P, G127S-A128P-T210P, T77N-G127S-T210P, G127S-T210P-S258P, M123-G165Q-T210P, T3V-G127S-T210P, G127S-G165Q-T210P, T3V-M123I-T210P, G127S-A202V-T210P, G127S-N184Q-T210P, G127S-T210P-N217S, G127T-N184Q-N217S, M123I-A202V-T210P, M123I-T210P-S258P, A68S-G127T-N184Q, A68S-G127T-N217S, G127T-A128P-N184Q, G127T-A128P-N217S, T77N-V87S-G165Q, A68S-G127T-A128P, G127T-G165Q-N184Q, G127T-G165Q-N217S, T77N-G127T-N184Q, T77N-G127T-N217S, A68S-G165Q-S258D, A68S-T77N-G127T, A68S-T77N-S258D, G127T-A128P-G165Q, T77N-G127T-A128P, and T77N-G165Q-S258D; or (ii) N184Q-N217S, T77N-N217S, T77N-N184Q, T77N-G165Q, G165Q-N184Q, G165Q-N217S, A128P-N217S, A68S-T77N, T77N-A128P, A68S-N217S, A128P-N184Q, A68S-N184Q, A68S-G165Q, A128P-G165Q, A68S-A128P, A202V-N217S, N184Q-A202V, G165Q-A202V, T3V-N217S, T3V-N184Q, T3V-T77N, T77N-A202V, A68S-A202V, T3V-A128P, T3V-G165Q, A128P-A202V, T3V-A68S, T3V-A202V, N184Q-S258P, N217S-S258P, M123I-N217S, M123I-N184Q, T3V-M123I, T77N-S258P, A128P-S258P, G165Q-S258P, T77N-M123I, A202V-S258P, M123I-G165Q, A68S-M123I, A68S-S258P, M123I-A128P, M123I-A202V, T3V-S258P, A68S-G127S, G127S-A128P, T77N-G127S, G127S-A202V, G127S-N184Q, G127S-N217S, G127S-G165Q, M123I-S258P, T3V-0127S, G127S-S258P, M123I-G127S, T77N-T210P, A128P-T210P, A202V-T210P, A68S-T210P, G165Q-T210P, T210P-S258P, T3V-T210P, N184Q-T210P, T210P-N217S, G127S-T210P, M123I-T210P, T78I-A202V, A68S-S258D, G165Q-S258D, T77N-S258D, T77N-T78I, T78-G165Q, G127T-N184Q, G127T-N217S, N184Q-S258D, N217S-S258D, A202V-S258D, A68S-T78I, T78I-A128P, T78I-G127S, A68S-G127T, T78I-N184Q, G127T-A128P, G127T-A202V, T3V-T78I, T78I-N217S, G127T-G165Q, L10M-A202V, T77N-G127T, T78I-S258P, T3V-G127T, T78I-M123, V87S-A202V, A128P-A242G, A128P-S258D, G165Q-A242G, I35A-A202V, M123I-S258D, T3V-A242G, T3V-S258D, T77N-A242G, S86H-S258P, G127T-S258P, P9E-T77N, S86H-A202V, S86H-G165Q, S86H-N184Q, T78I-T210P, A202V-A242G, A242G-S258P, A68S-A242G, A68S-G165E, G127S-A242G, G165E-N184Q, G165E-N217S, I35A-V87S, L10M-M123I, M123I-G127T, N184Q-A242G, N217S-A242G, A128R-G165Q, A128R-S258D, A68S-A128R, A68S-G99S, G127S-S258D, G165E-A202V, G99S-A128P, G99S-G127S, G99S-G165Q, I35A-G165Q, I35A-T77N, L10M-A128P, L10M-A68S, L10M-N184Q, L10M-

N217S, L10M-S258P, L10M-T77N, M231-A242G, P9E-A128P, P9E-A202V. P9E-A68S, P9E-G165Q, P9E-N184Q, P9E-N217S, P9E-S258P, S86H-T115F, T210P-A242G, T3V-G165E, T3V-G99S, T3V-L10M, T3V-P9E, T77N-A128R, T77N-G165E, T77N-G99S, T77N-V87S, T78I-A242G, V87S-A128P, V87S-G165Q, V87S-M123I, V87S-N217S, A68S-G101A, G101A-A128P, G101A-G165Q, G101A-S258P, G165E-S258P, G99S-S258P, I35A-M123I, I35A-N217S, L10M-G127S, L10M-G165Q, M123I-G165E, P9E-T210P, S187E-A202V, S86H-N217S, T115F-A202V. T115F-G165Q. T115F-S258P, T3V-G101A, T3V-V87S, T77N-G101A, T77N-G203E, T78I-S258D, A128P-G165E, A128R-A202V, A128R-N184Q, A128R-N217S, A68S-G99Q, G101A-A202V, G101A-G127S, G101A-N184Q, G101A-N217S, G165Q-G203E, G99Q-A128P, G99Q-G165Q, G99Q-N184Q, G99Q-N217S, G99S-A242G, G99S-T210P, I35A-A128P, I35A-T78I, L10M-T20P, L10M-T78I, P9E-G127S. P9E-M123I, T3V-I35A. T77N-G99Q, T78I-G99S, T78I-V87S. V87S-N184Q, A143V-A202V, A143V-G165Q, A143V-S258P, A1Q-N184Q, A1Q-S86H, A68S-G203E, A68S-S187E, A68S-V87S, G101A-M123I, G101A-T210P, G99Q-A202V, G99S-A202V, G99S-M123I, G99S-N184Q, G99S-N217S, I35A-N184Q, L10M-I35A, L10M-V87S, M123I-A128R, N184Q-G203E, N184Q-S187E, S187E-N217S. S250G-S258P, S86H-A143V, T115F-A143V, T115F-N184Q, T115F-N217S. T3V-A128R, T3V-G99Q, T3V-S86H, T77N-S187E, T77N-N184Q-N217S, A128P-N184Q-N217S, T77N-A 128P-N217S, A68S-N184Q-N217S, A68S-T77N-N217S, G165Q-N184Q-N217S, T77N-A128P-N184Q, T77N-G165Q-N217S, T77N-G65Q-N184Q, A68S-T77N-G165Q, A68S-T77N-N184Q, T77N-A128P-G165Q. A128P-G165Q-N217S, A68S-A128P-N217S. A68S-T77N-A128P. A68S-G165Q-N217S, A128P-G165Q-N184Q, A68S-A128P-N184Q, A68S-A128P-G165Q, A68S-G165Q-N184Q, N184Q-A202V-N217S, G165Q-A202V-N217S, T77N-A202V-N217S, T3V-N184Q-N217S, A68S-A202V-N217S, T3V-T77N-N217S, A128P-A202V-N217S, G165Q-N184Q-A202V, T77N-N184Q-A202V, T3V-A128P-N217S, T3V-T77N-A128P, T3V-T77N-N184Q, T77N-G165Q-A202V, A128P-N184Q-A202V, A68S-N184Q-A202V, T3V-A128P-N184Q, A68S-T77N-A202V. T77N-A128P-A202V, T3V-G165Q-N217S, T3V-T77N-G165Q, T3V-A68S-N217S, T3V-A68S-T77N, A128P-G165Q-A202V, A68S-A128P-A202V, T3V-G165Q-N184Q, A68S-G165Q-A202V, T3V-A128P-G165Q, T3V-A68S-A 128P, T3V-A68S-N184Q, T3V-A68S-G165Q, T3V-A202V-N217S, T3V-N184Q-A202V, T3V-T77N-A202V, T3V-A128P-A202V, T3V-G165Q-A202V, T3V-A68S-A202V, N184Q-N217S-S258P, T3V-M1 123I-N217S, M123I-N184Q-N217S, T77N-M123I-N217S, A128P-N184Q-S258P, A128P-N217S-S258P, A68S-M123I-N217S, M123I-G165Q-N217S, T77N-A128P-S258P, T77N-M123I-N184Q, T77N-N184Q-S258P, M123I-A128P-N217S, T3V-M123I-N184Q, T77N-N217S-S258P, A202V-N217S-S258P. A68S-M123I-N184Q, M123I-A128P-N184Q, N184Q-A202V-S258P, T3V-M123I-G165Q, T3V-T77N-M123I, T77N-M123I-G165Q, A68S-A128P-S258P. A68S-T77N-M123I, M123I-G165Q-N184Q, T3V-A68S-M123I, A68S-N184Q-S258P, G165Q-N184Q-S258P, G165Q-N217S-S258P, M123I-A202V-N217S, T3V-M123I-A128P, T77N-M123I-A128P, A128P-G165Q-S258P, A68S-N217S-S258P, M123I-A128P-G165Q, T3V-N217S-S258P, T77N-G165Q-S258P, A68S-M123I-A128P, A68S-M123I-G165Q, A68S-T77N-S258P, T3V-A128P-S258P, T3V-N184Q-S258P, G165Q-A202V-S258P, T3V-M123I-A202V, A128P-A202V-S258P, M123I-N184Q-A202V, T3V-T77N-S258P, A68S-A202V-S258P, A68S-G165Q-S258P, M123I-G165Q-A202V, T77N-A202V-S258P, T77N-M123I-A202V, A68S-M123I-A202V, M123I-A128P-A202V, T3V-A202V-S258P, T3V-A68S-S258P, T3V-G165Q-S258P, A68S-G127S-A128P, A68S-T77N-G127S, T77N-G127S-A128P, A68S-G127S-A202V, A68S-G127S-N184Q, A68S-G127S-N217S, G127S-A128P-A202V, G127S-A128P-N184Q, G127S-A128P-N217S, A68S-G127S-G165Q, G127S-A128P-G165Q, G127S-A202V-N217S, G127S-N184Q-A202V, G127S-N184Q-N217S, T77N-G127S-A202V, T77N-G127S-N184Q, T77N-G27S-N217S, T77N-G27S-G165Q, T3V-A68S-G127S, T3V-G127S-A128P, G127S-G165Q-A202V, G127S-G165Q-N184Q. G127S-G165Q-N217S, M123I-A202V-S258P, M123I-N217S-S258P, M123I-N184Q-S258P, T3V-M123I-S258P, T3V-T77N-G127S, A68S-G127S-S258P, G127S-A128P-S258P, M123I-A128P-S258P, T3V-G127S-A202V, T3V-G127S-N184Q, T3V-G127S-N217S, A68S-M123I-S258P, T3V-G127S-G165Q, T77N-G127S-S258P, M123I-G165Q-S258P. T77N-M123I-S258P, G127S-A202V-S258P. G127S-N184Q-S258P, G127S-N217S-S258P, T3V-G127S-S258P, G127S-G165Q-S258P, A68S-M123I-G127S, M123I-G127S-A 128P, M123I-G127S-A202V, M123I-G127S-N184Q, M123I-G127S-N217S, T77N-M123I-G127S, T3V-M123I-G127S, M123I-G127S-G165Q, M123I-G127S-S258P, A68S-A128P-T210P, A68S-T77N-T210P, T77N-A128P-T210P, N184Q-A202V-T210P, T3V-A128P-T210P. T3V-A68S-T210P, T3V-T77N-T210P, T77N-G165Q-T210P, T77N-T210P-S258P, A128P-G165Q-T210P, A128P-T210P-S258P, A202V-T210P-N217S, A68S-G165Q-T210P, A68S-T210P-S258P, N184Q-T210P-N217S, T3V-G165Q-T210P, T77N-A202V-T210P, A128P-A202V-T210P, A128P-N184Q-T210P, A128P-T210P-N217S, A202V-T210P-S258P, A68S-A202V-T210P, A68S-N184Q-T210P, A68S-T210P-N217S, G165Q-A202V-T210P, G165Q-T210P-S258P, T3V-A202V-T210P, T3V-N184Q-T210P, T3V-T210P-S258P. T77N-N184Q-T210P, T77N-T210P-N217S, G165Q-N184Q-T210P, N184Q-T210P-S258P, T210P-N217S-S258P, T3V-T210P-N217S, G165Q-T210P-N217S, A68S-G127S-T210P, G127S-A128P-T210P, T77N-G127S-T210P, G127S-T210P-S258P, T3V-G27S-T210P, G127S-G165Q-T210P, A68S-M123I-T210P, G127S-A202V-T210P, G127S-N184Q-T210P, G127S-T210P-N217S, M123I-A128P-T210P, M123I-A202V-T210P, M123I-N184Q-T210P, M123I-T210P-N217S, T3V-M123I-T210P, T77N-M123I-T210P, M123I-G165Q-T210P, M123I-T210P-S258P, A68S-G165Q-S258D, A68S-T77N-S258D, T77N-G165Q-S258D, T77N-T78I-G165Q, A68S-N184Q-S258D, A68S-N217S-S258D, G127T-N184Q-N217S, G165Q-N184Q-S258D, G165Q-N217S-S258D, M123I-G127S-T210P, T77N-N184Q-S258D, T77N-N217S-S258D. A68S-T77N-T78I, A68S-T78I-A128P, A68S-T78I-G127S, A68S-T78I-G165Q, T77N-T78I-A128P, T77N-T78I-G127S, T78I-A128P-G165Q, T78I-G127S-A128P, T78I-G127S-G165Q, A68S-G127T-N184Q, A68S-G127T-N217S, N184Q-N217S-S258D, T77N-T78-N184Q, T78I-G165Q-N184Q, A202V-N217S-S258D, A68S-A202V-S258D, G127T-A128P-N184Q, G127T-A128P-N217S, G127T-A202V-N217S, G127T-N184Q-A202V, G165Q-A202V-S258D, T3V-T77N-T78I, T3V-T78I-G165Q, T77N-A202V-S258D, T77N-T78I-A202V, T77N-T78I-N217S, T78I-G165Q-A202V, T78I-G165Q-N217S, T78I-N184Q-A202V, T78I-N184Q-N217S, A68S-G127T-A128P, A68S-T78I-A202V, A68S-T78I-N184Q, A68S-T78I-N217S, G127T-G165Q-N184Q, G127T-G165Q-N217S, T3V-A68S-178I, T3V-T78I-A128P, T3V-T78I-G127S, T77N-G127T-N184Q, T77N-G127T-N217S,

T77N-T78I-S258P, T78I-A128P-A202V, T78I-A128P-N184Q, T78I-A128P-N217S, T78I-A202V-N217S, T78I-G127S-A202V, T78I-G127S-N184Q, T78I-G127S-N217S, I78I-G165Q-S258P, A68S-G127T-A202V, A68S-T77N-G127T, G127T-A128P-G165Q, N184Q-A202V-S258D, T3V-G127T-N184Q, T3V-G127T-N217S, T77N-G127T-A128P, T78-M123I-A202V, A128P-G165Q-A242G, A128P-G165Q-S258D, A128P-N184Q-S258D, A128P-N217S-S258D, A68S-A128P-S258D, A68S-G127T-G165Q, A68S-T78I-S258P, G127T-A128P-A202V, T3V-A128P-A242G, T3V-A68S-G127T, T3V-A68S-S258D, T3V-G127T-A202V, T3V-G165Q-A242G, T3V-G65Q-S258D, T3V-T77N-A242G, T3V-T77N-S258D, T3V-T78I-N184Q, T3V-T78I-N217S, T3V-T78I-S258P, T77N-A128P-A242G, T77N-A128P-S258D, T77N-G127T-G165Q, T77N-G165Q-A242G, T78I-A128P-S258P, T78I-G127S-S258P, A68S-M123I-S258D, G127T-G165Q-A202V, M123I-G165Q-S258D, T3V-G127T-A128P, T3V-N217S-S258D, T3V-T78I-A202V, T77N-G127T-A202V, T77N-M123I-S258D, T77N-T78I-M123I, T78I-M123I-G165Q, T78I-M123I-N184Q, T78I-N184Q-S258P, A68S-T78I-M1231. A68S-T78-T210P, G127T-N184Q-S258P, G127T-N217S-S258P, M123I-A202V-S258D, M123I-N217S-S258D, T3V-A202V-S258D, T3V-M123I-S258D, T3V-N184Q-S258D, T3V-T77N-G127T, T3V-T78I-T210P, T77N-T78-T210P, T78I-A128P-T210P, T78I-A202V-S258P, T78I-G127S-T210P, T78-G165Q-T210P, T78-M123I-A128P, T78I-M123I-G127S, T78I-M123I-N217S, and T78I-N217S-S258P; with the proviso that one or more of said two, three, or four or more substitutions is a man-made substitution; wherein said variant has at least 85% but less than 100% amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

Another embodiment is directed to one or more subtilisin variant comprising an amino acid sequence comprising one or more amino acid substitution sets selected from: M123I-Q136R; P9E-M1231; V45R-M123I; G127T-G165S-T210E; M123I-G165S-N239S; M123-Q136R-G165Q; M123-Q136R-S258E; M123I-V146S-T210E; P9E-V45R-M123I; Q136R-G165Q-S258E; V45R-M123I-Q136R; G127T-V146S-G165S-N239S; L10M-K27R-S98H-M123I; M123I-Q136R-G165Q-S258E; M123I-V146S-G165S-T210P; M123I-V146S-T210P-S250G: P9E-M123I-Q136R-G165Q; P9E-Q136R-G65Q-S258E: P9E-V45R-M123I-Q136R; V45R-M123I-Q136R-G165Q; V45R-M123I-Q136R-S258E; V45R-Q136R-G165Q-S258E; K27R-N43A-S98H-M123I-T210H; P9E-M123I-Q136R-G165Q-S258E; P9E-V45R-M123I-Q136R-G165Q; P9E-V45R-M123I-Q136R-S258E; V45R-M123I-Q136R-G165Q-S258E; Y103I-G127T-V146S-G165S-N239S; T77H-V87T-M123I-Q136R-N184Q-N239S; V26R-V45R-S98R-E111Q-M123I-Q136R; T77H-V87T-M123I-Q136R-G165Q-N184Q-N239S; T77S-V87S-M123-Q136R-G165Q-S187P-S258P; T77S-V87S-M123I-Q136R-N160C-S187P-S258P; T77H-V87T-M123I-Q136R-N184Q-S187P-N239S-S258P; T3Q-K22Y-A24N-V45I-A481-T77N-N217S-L2341-Y255R; P9E-T77Q-V87T-M123I-Q136R-G165Q-N184Q-N217S-N239S-S258E; N43A-V45R-T77H-V87T-M123I-Q136R-G165A-N184Q-S187P-N239S-S258P; P9E-N43A-V45R-T77S-V87S-M123I-Q136R-G165Q-S187P-N217S-S258P; P9E-N43A-V45R-T77H-V87T-M123I-Q136R-G165Q-N184Q-S187P-N239S-S258P; P9E-N43A-V45R-T77Q-V87T-M123I-Q136R-G165Q-N184Q-N217S-N239S-S258E; P9E-N43A-V45R-T77H-V87T-M123I-Q136R-G165A-N184Q-S187P-N217S-N239S-S258E: T77N-N217S-L234W; T77N-N217S, T77N-G126Q-G65Q-T210P-N217S-L234W-S258P, T77N-G127F-G65Q-A202V-T210P-N217S-L234W-S258P; A1Q-T3V-V28A-I35A-A68S-T77N-S86H-T115F-N217S-N239S-S250G-S258P-Q274A; T77N-M123I-T210P-N239S-S250G-S258P; V45I-A68S-T77N-M123I-L125N-G165Q-N217S-S258P; A68S-V71A-T77N-L95A-G165Q-N184Q-T210P-S258P; M123I-T210P-N217S-S258P; G127F-G165Q-N217S-S258P; T77N-G165Q-N217S-S258P; T77S-G65A-N184Q-T210P-N217S; A68S-T77N-A128P-G165Q-N184Q-N217S; V71A-T77S-N184Q-S258P; T77N-M123I-G165Q-N184Q-N217S; V71A-L95A-A128S-T210P; V71A-M123I-A128S-T210P; V71A-M123I-A128S-G165E: T77S-A128P-N184Q-N217S-F260W; T77H-A128S-G165Q-T20P; T77D-S86R-S155E-G165A-N184Q; A68S-V71A-T77N-A128S-G165Q-T210P-N217S; V28A-I35A-A68S-T77N-A128S-G165Q-N184Q-G203N-T210P; A128P-T210P; T210P-S258P; A128P-T210P-S259P; A128P-S187P-T210P; A128P-S187P-T210P-S258P; P9E-T77S-V87T-T210P-N239K; K15I-L95Q-M123I-G165S-T210P-N217S; K151-M123I-V146S-G165S-T210P-N239S; K15I-N76K-M123I-V146S-G165S-T210P-N239S; K15I-V146S-G165S-T210P-N239S; P009E-V146S-N184Q-G203E-T210P-P238R-N239S; M123I-G165S-N217S; K151-L95Q-S108K-G65S-G203E-T210P-N217S; K15I-L95Q-S108K-G65S-G203E-T210P; P9E-K15I-G165S-A193D-G203E-T210P; T77N-M123I-G165Q-N217S; T77H-G165Q; T77N-G165Q-N217S; A68S-V71A-T77N-G165Q-N217S; T77N-V87S-M123I-S155G-G165Q-N217S; T77H-V87S-S155G-G165Q; T77N-V87S-S155G-G165Q-N217S; T77N-M123I-G165Q; T77N-G165Q; A68S-V71A-T77N-G165Q; T77N-V87S-M123I-S155G-G165Q; I35A-A68S-T77N-V87S-V147L-G165Q; A68S-T77N-V87S-V147L-S155E-G165Q; T77N-V87S-M123I-V147L-S155G-G165Q; A68S-T77N-M123I-G165Q-N184Q-N217S; T77N-M123I-A128P-G165Q-N184Q-N217S; A68S-V71A-T77N-S100N-A 128P-G165Q-N184Q-T210P-N217S-N239T; T77N-A128P-G165Q-N184Q-N217S; A68S-A128P-G165Q-N184Q-N217S; A68S-T77N-G165Q-N184Q-N217S; A68S-T77N-A128P-N184Q-N217S; A68S-T77N-A128P-G165Q-N217S; A68S-T77N-A128P-G165Q-N184Q; M123I-G165Q-N184Q-N217S; T77N-G165Q-N184Q-N217S; T77N-M123I-N184Q-N217S; T77N-M123I-G165Q-N184Q; T3V-A68S-T77N-A128P-G165Q-N184Q-N217S; T3V-A68S-T77N-M123I-A128P-G165Q-N184Q-N217S; T3V-T77N-M123I-G165Q-N184Q-N217S; A68S-T77N-S108H-A128P-G165Q-N184Q-N217S; A68S-T77N-G99S-A128P-G165Q-N184Q-N217S; A68S-T77N-T114N-A28P-G 165Q-N184Q-N217S; A68S-T77N-M123I-A128P-G165Q-N184Q-N217S; A68S-T77N-G127T-A128P-G165Q-N184Q-N217S; A68S-T77N-A128P-G165Q-N184Q-T210P-N217S; A68S-T77N-G99S-M123I-A128P-G165Q-N184Q-N217S; A68S-T77N-G99S-G127T-A128P-G165Q-N184Q-N217S; A68S-T77N-G99S-A128P-G165Q-N184Q-T210P-N217S; A68S-T77N-T114N-M123I-A128P-G165Q-N184Q-N217S; A68S-T77N-T114N-G127T-A128P-G165Q-N184Q-N217S; A68S-T77N-T14N-A128P-G165Q-N184Q-T210P-N217S; A68S-T77N-M123I-G127T-A128P-G165Q-N184Q-N217S; A68S-T77N-M123I-A128P-G165Q-N184Q-T210P-N217S; A68S-T77N-G127T-A128P-G165Q-N184Q-T210P-N217S; A68S-T77N-G99S-M123I-A 128P-G165Q-N184Q-

T210P-N217S; A68S-T77N-M123I-G127T-A128P-G165Q-N184Q-T210P-N217S; T3V-A68S-T77N-G99S-M123I-A128P-G165Q-N184Q-N217S; T3V-A68S-T77N-T114N-M123I-A128P-G165Q-N184Q-N217S; T3V-A68S-T77N-M123I-G127T-A128P-G165Q-N184Q-N217S; T3V-A68S-T77N-M123I-A128P-G165Q-N184Q-T210P-N217S; S86H-T115F-A143V-G165Q-A202V-S258P; S86H-L95A-N184Q-A202V-T210P-N217S-L234W-S250G-S258P; V30T-I35A-T77N-G165Q-A202V-T210P-S250G-S258P; A1Q-T3V-I35A-T77N-T78I-S86H-T115F-G165Q-N184Q-N217S-L234V-S258P; A1Q-A37T-T77N-T78I-S86H-M123I-G165Q-N184Q-A202V-N239S-S250G-S258P-Q274A; P9E-T77N-N96S-G165Q-G203E-S250G: P9E-T77N-N96S-G165E-G203E-T210P-S250G; A1Q-T3V-S86H-G130S-S155G-G165Q-N184Q-A202V-G203N-T210P-Q274A; A1Q-T3V-S86H-G165Q-N184Q-N239S-S250G-S258P; A1Q-T77N-S86H-V147L-A151G-N184Q-N217S-S258P; S86H-T1 15F-S155G-G165Q-N184Q-A202V-Q274A; A68S-S86H-T115F-N184Q-A202V-G203N-N239S-S250G-S258P-Q274A; A68S-T77N-V87S-A128P-S155G-G165Q-N217S; A68S-T77N-A128P-G165Q; A68S-T77N-V87S-A128P-S155G-G165Q; I35A-A68S-T77N-V87S-A128P-V147L-G165Q-N217S; A68S-T77N-V87S-A128P-S155G-G165Q-N217S-A242G: A68S-T77N-V87S-A128P-V147L-S55E-G165Q; A68S-T77N-V87S-A128P-S155E-G165Q-N217S; A68S-T77N-S86N-V87S-A128P-S155G-G165Q-N217S-A242G; I35A-A68S-T77N-A128P-V147L-G165Q-N217S; I35A-A68S-T77N-A128P-S155G-G165Q-A242G: I35A-A68S-T77N-A128P-V147L-G165Q-A242G; A68S-T77N-V87S-A128P-S155G-G165Q-A242G; A068S-T077N-N086S-G165Q-K194E-S211N-N217S; A068S-T077N-N086S-V087S-S155G-G165Q-K194E-S211N-N217S; A068S-T077N-N086S-G165Q-K194E-S211N; A068S-T077N-N086S-V087S-S155G-G165Q-K194E-S211N; I035A-A068S-T077N-N086S-V087S-V147L-G165Q-K194E-S211N-N217S; A068S-T077N-N086S-V087S-S155G-G165Q-K194E-S211N-N217S-A242G; A068S-T077N-N086S-V087S-V147L-S155E-G165Q-K194E-S211N; A068S-T077N-N086S-V087S-S155E-G165Q-K194E-S211N-N217S; A068S-T077N-V087S-S155G-G165Q-K194E-S211N-N217S-A242G; 1035A-A068S-T077N-N086S-V147L-G165Q-K194E-S211N-N217S; I035A-A068S-T077N-N086S-S155G-G165Q-K194E-S211N-A242G; 0135A-A068S-T077N-N086S-V147L-G165Q-K194E-S211N-A242G; A068S-T077N-N086S-V087S-S155G-G165Q-K194E-S211N-A242G; A68S-T77N-G127T-A128P-G165Q-N184Q-A202V-N217S; T3V-A68S-T77N-M123I-A128P-G165Q-N184Q-A202V-N217S; A68S-T77N-G127T-A128P-G165Q-N184Q-N217S-S258P; T3V-A68S-T77N-M123I-A128P-G165Q-N184Q-N217S-S258P; A68S-T77N-G127T-A128P-G165Q-N184Q-G203Q-N217S; T3V-A68S-T77N-M123I-A128P-G165Q-N184Q-G203Q-N217S; A68S-T77N-A128P-G165Q-N184Q-A202V-N217S-S258P; T3V-A68S-T77N-M123I-A128P-G165Q-N184Q-A202V-N217S-S258P; A68S-T77N-A128P-G165Q-N184Q-G203Q-N217S-S258P; T3V-A68S-T77N-M123I-A128P-G165Q-N184Q-G203Q-N217S-S258P; S86H-T115F-G127T-A143V-G165Q-N184Q-A202V-N217S-S258P; T3V-S86H-T115F-M123I-A143V-G165Q-A202V-N217S-S258P; A68S-T77N-A128P-S129H-G165Q-N184Q-A202V-N217S: T3V-A68S-T77N-M123I-A128P-S129H-G165Q-N184Q-A202V-N217S; S86H-T115F-S129H-A143V-G165Q-N184Q-A202V-N217S-S258P; T3V-S86H-T115F-M123I-S129H-A143V-G165Q-A202V-N217S-S258P; A68S-T77N-A128P-S155N-G165Q-N184Q-A202V-N217S; T3V-A68S-T77N-M123I-A128P-S155N-G165Q-N184Q-A202V-N217S; I35A-A68S-T77N-V87S-A128P-V147L-G165Q-A202V-N217S; T3V-I35A-A68S-T77N-V87S-M123I-A128P-V147L-G165Q-A202V-N217S; A68S-T77N-A128P-Q136N-S155N-G165Q-N184Q-N217S-A242N; T3V-A68S-T77N-M123I-A128P-Q136N-S155N-G165Q-N184Q-N217S-A242N; A68S-V71A-T77N-A128P-G165Q-N184Q-A202V-N217S; T3V-A68S-V71A-T77N-M123I-A128P-G165Q-N184Q-A202V-N217S; A68S-T77N-A128P-G165Q-N184Q-S187P-A202V-N217S; T3V-A68S-T77N-M123I-A128P-G165Q-N184Q-S187P-A202V-N217S; A68S-T77N-A128R-G165Q-N184Q-A202V-N217S-S258D: T3V-A68S-T77N-M123I-A128R-G165Q-N184Q-A202V-N217S-S258D; A68S-T77N-A128P-S129R-G165Q-N184Q-N217S-S258D; T3V-A68S-T77N-M123I-A128P-S129R-G165Q-N184Q-N217S-S258D: A68S-T77N-A128R-G165Q-N184Q-A202V-N217S-S258D-K264H; T3V-A68S-T77N-M123I-A128R-G165Q-N184Q-A202V-N217S-S258D-K264H; A68S-T77N-A128R-G165Q-N184Q-G203E-S258D; T3V-A68S-T77N-M123I-A128R-G165Q-N184Q-G203E-S258D; T3V-A68S-T77N-M123I-A128R-G165Q-N184E-A202V-N217S-S258D; T3V-A52R-A68S-T77N-M123I-A128R-G165Q-N184E-A202V-N217S-S258D; T3V-T77N-S100N-G105N-D119Q-A128P-S158N-N160D-T161Q-G165A-N184Q-N217S-S258P-K264S; T3V-T77N-S100N-G105N-A128P-S158D-T161Q-G165A-N184Q-N217S-S258P; T3V-T77N-100N-G105N-A128P-S158N-N160D-T161Q-G165A-N184Q-N217S-S258P; A24Q-V45I-A68S-T77N-S98R-E1 1Q-M123I-S158Q-G165E-N184Q-S187E-V204I-T210I-N217S-S259E; P9E-A52R-S86R-E111Q-S129R-S158Q-G165E-V204I-T210I-S258D-S259E-K264Q: T3V-A68S-T77N-G127T-A128P-G165Q-N184Q-A202V-N217S; T3V-35A-T77N-V87S-M123I-A128P-G165Q-N184Q-A202V-N217S-A242G; T3V-A68S-T77N-G127E-A128P-G165Q-N184Q-A202V-N217S; T3V-A68S-T77N-M123I-G127V-A128P-G165Q-N184Q-N217S; T3V-A68S-T77N-M123I-A128P-A151G-G165Q-N184Q-N217S; T3V-A68S-T77N-G127T-A128P-A151G-G165Q-N184Q-N217S; T3V-T77N-M123I-A128P-A151G-G165Q-N184Q-A202V-N217S; T3V-A68S-T77N-L95F-A128P-G165Q-N184Q-A202V-N217S; T3V-A68S-T77N-L95A-M123I-A128P-G165Q-N184Q-N217S; T3V-A68S-T77N-L95F-M123I-A128P-G165Q-N184Q-N217S: T3V-A68S-T77N-G99A-A128P-G165Q-N184Q-A202V-N217S; T3V-A68S-T77N-G99E-A128P-G165Q-N184Q-A202V-N217S; T3V-A68S-T77N-G99Q-A128P-G165Q-N184Q-A202V-N217S; T3V-A68S-T77N-G99A-M123I-A128P-G165Q-N184Q-N217S: T3V-A68S-T77N-S108H-A 128P-G165Q-N184Q-N217S: T3V-I35A-T77N-V87S-M123I-A128P-V146A-G165Q-N184Q-A202V-N217S-A242G; T3V-A68S-T77N-G127T-A128P-G165E-N184Q-A202V-N217S; T3V-A68S-T77N-M123I-A128P-V146A-G165Q-N184Q-N217S; T3V-A68S-T77N-M123I-A128P-T161D-G165Q-N184Q-A202V-N217S; T3V-V45R-A68S-T77N-S102D-A128P-T161D-G165Q-N184Q-A202V-N217S; T3V-A68S-T77N-G127T-A128P-G165Q-N184Q-A202V-N217S-S258P; T3V-A68S-T77N-M123I-G127T-A128P-G165Q-N184Q-A202V-N217S-S258P; T3V-A68S-T77N-M123I-G127V-A128P-G165Q-N184Q-A202V-N217S-S258P; T3V-A68S-T77N-M123I-G127S-A128P-G165Q-N184Q-A202V-N217S-S258P; T3V-I35A-T77N-V87S-G127T-A128P-G165Q-N184Q-A202V-N217S-A242G-S258P; T3V-T77N-M123I-G127Q-A128P-G165Q-N184Q-A202V-N217S-S258P; T3V-T77N-M123I-G127V-A128P-G165Q-N184Q-A202V-N217S-S258P; T3V-T77N-M123I-G127E-A128P-G165Q-N184Q-A202V-N217S-S258P; T3V-A68S-T77N-

M123I-G127T-A128P-G165Q-N184Q-A202V-N217S; T3V-A68S-T77N-M123I-G127T-A128P-G165Q-N184Q-A202V-T210P-N217S; T3V-A68S-T77N-M123I-G127T-A128P-G165Q-N184Q-A202V-T210P-N217S-S258P; T3V-A68S-T77N-M123I-G127T-A128P-G165Q-N184Q-A202V-N217S-S258D; L10M-35A-T78I-V87S-M123I-A202V-S258D-F260W; L10M-35A-T78I-V87S-M123I-A202V-F260W-K264H; L10M-I35A-T78I-V87S-A202V-S258D L10M-I35A-T78I-V87S-S187E-A202V; L10M-T78I-V87S-S187E-A202V; L10M-I35A-T78-S187E-A202V; T3V-L10M-A68S-T77N-M123I-G127S-A128P-G165Q-N184Q-A202V-N217S-S258P; T3V-I35A-A68S-T77N-M123I-G127S-A128P-G165Q-N184Q-A202V-N217S-S258P; T3V-A68S-T77N-T78I-M123I-G127S-A128P-G165Q-N184Q-A202V-N217S-S258P; T3V-A68S-T77N-V87S-M123I-G127S-A128P-G165Q-N184Q-A202V-N217S-S258P; T3V-A68S-T77N-M123I-G127S-A128P-G165E-N184Q-A202V-N217S-S258P; T3V-A68S-T77N-M123-G127S-A128P-G165Q-N184Q-A202V-T210P-N217S-S258P; T3V-A68S-T77N-M123I-G127S-A128P-G165Q-N184Q-A202V-L216Q-N217S-S258P; T3V-A68S-T77N-M123I-G127S-A128P-G165Q-N184Q-A202V-N217S-A242G-S258P; T3V-A68S-T77N-M123I-G127S-A128P-G165Q-N184Q-A202V-N217S-S258D; T3V-A68S-T77N-M123I-G127S-A128P-G165Q-N184Q-A202V-N217S-S258P-F260W; A68S-T77N-M123I-G127S-A128P-G165Q-N184Q-A202V-N217S-S258P; T3V-A68S-T77N-G127S-A128P-G165Q-N184Q-A202V-N217S-S258P; T3V-L311-A68S-T77N-M123I-G127S-A128P-G165Q-N184Q-A202V-N217S-S258P; A68S-T77N-G127S-A128P-G165Q-N184Q-A202V-N217S-S258P; A68S-T77N-G127S-A128P-G165Q-N184Q-A202V-T210P-N217S-S258P; A68S-T77N-G127T-A128P-G165Q-N184Q-A202V-N217S-S258P; T3V-A68S-T77N-T78I-M123I-G127S-A128P-G165Q-N184Q-A202V-N217S-S258D; A68S-T77N-T78I-M123I-G127S-A 128P-G165Q-N184Q-A202V-N217S-S258D; T3V-A68S-T77N-T78I-G127S-A128P-G165Q-N184Q-A202V-N217S-S258P; A68S-T77N-T78I-G127S-A128P-G165Q-N184Q-A202V-N217S-S258P; T3V-A68S-T77N-G127S-A128P-G165Q-N184Q-A202V-N217S-S258D; A68S-T77N-G127S-A128P-G165Q-N184Q-A202V-N217S-S258D; T3V-A68S-T77N-T78I-G127S-A128P-G165Q-N184Q-A202V-N217S-S258D; A68S-T77N-T78I-G127S-A128P-G165Q-N184Q-A202V-N217S-S258D; T3V-A68S-T77N-S108H-G127S-A128P-G165Q-N184Q-A202V-N217S-S258P; T3V-A68S-T77N-G99Q-A128P-G165Q-N184Q-A202V-N217S-S258P; T3V-A68S-T77N-G99Q-A128P-G165Q-N184Q-A202V-T210P-N217S-S258P; T3V-A68S-T77N-G127S-A128P-G165E-N184Q-A202V-N217S-S258P; T3V-A68S-T77N-G127S-A128P-G165Q-N184Q-A202V-T210P-N217S-S258P; T3V-P9E-A68S-T77N-M123I-G127S-A128P-G165Q-N184Q-A202V-T210P-N217S-S258P; T3V-A68S-T77N-M123I-G127S-A128P-G165Q-N184Q-S187E-A202V-T210P-N217S-S258P; T3V-A68S-T77N-M123I-G127S-A128P-G165Q-N184Q-A202V-G203E-T210P-N217S-S258P; T3V-L10M-A68S-T77N-M123I-G127S-A128P-G165Q-N184Q-A202V-T210P-N217S-S258P; T3V-P9E-A68S-T77N-M123I-G127S-A128P-G165Q-N184Q-A202V-N217S-S258P; T3V-A68S-T77N-M123I-G127S-A128P-G165Q-N184Q-S187E-A202V-N217S-S258P; T3V-P9E-A68S-T77N-G127S-A128P-G165Q-N184Q-A202V-T210P-N217S-S258P; T3V-A68S-T77N-G127S-A128P-G165Q-N184Q-S187E-A202V-T210P-N217S-S258P; T3V-A68S-T77N-G127S-A128P-G165Q-N184Q-A202V-G203E-T210P-N217S-S258P; T3V-A68S-T77N-G101A-G127S-A128P-G165Q-N184Q-A202V-T210P-N217S-S258P; T3V-L10M-A68S-T77N-G127S-A128P-G65Q-N184Q-A202V-T210P-N217S-S258P; T3V-P9E-A68S-T77N-M123I-A128P-G165Q-N184Q-A202V-T210P-N217S-S258P; T3V-A68S-T77N-M123I-A128P-G165Q-N184Q-S187E-A202V-T210P-N217S-S258P; T3V-A68S-T77N-M123I-A128P-G165Q-N184Q-A202V-G203E-T210P-N217S-S258P; T3V-A68S-T77N-G101A-M123I-A128P-G165Q-N184Q-A202V-T210P-N217S-S258P; T3V-L10M-A68S-T77N-M123I-A128P-G165Q-N184Q-A202V-T210P-N217S-S258P; T3V-L10M-A68S-T77N-G101A-M123I-G127S-A128P-G165Q-N184Q-A202V-T210P-N217S-S258P; T3V-P9E-L10M-A68S-T77N-M123I-G127S-A128P-G165Q-N184Q-A202V-T210P-N217S-S258P; T3V-P9E-A68S-T77N-G99Q-A128P-G165Q-N184Q-A202V-T210P-N217S-S258P; T3V-A68S-T77N-M123I-G127S-A128P-G165Q-N184Q-A202V-T210P-N217S-S243I-S258P; T3V-A68S-M123I-G127S-A128P-G165Q-N184Q-A202V-N217S-S258P; T3V-A68S-T77N-M123I-G127S-A128P-N184Q-A202V-N217S-S258P; T3V-A68S-T77N-M123I-G127S-A128P-G165Q-A202V-N217S-S258P; T3V-A68S-T77N-M123I-G127S-A128P-G165Q-N184Q-A202V-S258P; T3V-A68S-T77E-M123I-G127T-A128P-G165Q-N184Q-A202V-N217S-S258P; T3V-A68S-T77E-M123I-G127S-A128P-G165Q-N184Q-A202V-N217S-S258P; T3V-A68S-T77N-M123I-G127S-A128P-G165Q-N184Q-A202V-N217S-S258P-K264H; T3V-A68S-T77N-S102T-M123I-G127S-A128P-G165Q-N184Q-A202V-N211S-N217S-S258P; T3V-A68S-T77N-M123I-G127S-A128P-G165Q-N184Q-A202V-N211S-N217S-S258P; T3V-A68S-T77N-S102T-M123I-G127S-A128P-G165Q-N184Q-A202V-N217S-S258P; T3V-A68S-T77N-M123I-G127S-A128P-G165Q-N184Q-A202V-N217S-S258P-S259P; T3V-A68S-T77N-M123I-G127S-A128P-T161Q-G165Q-N184Q-A202V-N217S-S258P; T3V-A68S-T77N-M123I-G127S-A128P-S158Q-G165Q-N184Q-A202V-N217S-S258P; T3V-V45Q-A68S-T77N-M123I-G127S-A128P-G165Q-N184Q-A202V-N217S-S258P; T3V-A68S-T77N-M123I-G127S-A 128P-G165Q-N184Q-A193Q-A202V-N217S-S258P; T3V-A68S-T77N-M123I-G127S-A128P-A43Q-G165Q-N184Q-A202V-N217S-S258P; T3V-A68S-T77N-G117S-M123I-G127S-A128P-G165Q-N184Q-A202V-N217S-S258P; T3V-A48V-A68S-T77N-M123I-G127S-A128P-G165Q-N184Q-A202V-N217S-S258P; T3V-A48T-A68S-T77N-M123I-G127S-A128P-G165Q-N184Q-A202V-N217S-S258P; T3V-A29S-A68S-T77N-M123I-G127S-A128P-G165Q-N184Q-A202V-N217S-S258P; T3V-A68S-T77N-G127S-A128P-G165Q-N184Q-A202V-N217S; T3V-A68S-T77N-G127S-A128P-G165Q-N184Q-N217S-S258P; T3V-A68S-T77N-A128P-G165Q-N184Q-A202V-N217S-S258P; A68S-T77N-M123I-G127S-A128P-G165Q-N184Q-A202V-N217S; A68S-T77N-M123I-A128P-G165Q-N184Q-A202V-N217S-S258P; T3V-A68S-T77N-G99Q-G127S-A128P-G165Q-N184Q-A202V-N217S-S258P; T3V-A68S-T77N-T78I-V87S-M123I-G127S-A128P-G165Q-N184Q-A202V-T210P-N217S-S258P; T3V-A68S-T77N-T78I-M123I-G127S-A128P-G165Q-N184Q-A202V-T210P-N217S-A242G-S258P; T3V-V26Q-A68S-T77N-M123I-G127S-A128P-G165E-N184Q-A202V-T210P-N217S-S258P; T3V-P9E-L10M-A68S-T77N-M123I-G127S-A128P-G165E-N184Q-A202V-T210P-N217S-S258P; T3V-P9E-L10M-A68S-T77N-G101 A-M123I-G127S-A128P-G165Q-N184Q-A202V-N217S-S258P; T3V-A68S-T77N-T78I-M123I-G127S-A128P-G165Q-N184Q-A202V-T210P-N217S-S258P; T3V-A68S-T77N-T78I-M123I-G127S-A128P-N160K-G65Q-N184Q-A202V-T210P-N217S-

A242G-S258P; T3V-A68S-T77N-V87S-M123I-G127S-A128P-G165Q-N184Q-A202V-T210P-N217S-S258P; T3V-P40E-A68S-T77N-M123I-G127S-A128P-G165Q-N184Q-A202V-N217S-S258P; T3V-A68S-T77E-M123I-G127T-A 128P-G165E-N184Q-A202V-N217S-P238Q-S258P; T3V-A68S-T77N-G99S-M123I-G127S-A128P-G165Q-N184Q-A202V-N217S-S258P; T3V-A68S-T77E-M123I-G127T-G165E-N184Q-A202V-N217S-S258P; A68S-T77N-A128P-G165Q-N184Q-N217S-S258P; T3V-A68S-T77N-G101A-S102T-M123I-G127S-A128P-G165Q-N184Q-A202V-N217S-S258P; T3V-A68S-T77N-M123I-G127S-A128P-G165Q-N184Q-A202V-N217S; T3V-A68S-T77N-T78I-G99S-G127S-A128P-G165Q-T210P-A242G-S258P-K264H: T3V-A68S-T77N-T78I-G99S-M123I-G127S-A128P-G165Q-N184Q-A202V-T210P-N217S-A242G-S258P; T3V-A68S-T77N-M123I-G127T-G165E-N184Q-A202V-N217S-P238Q-S258P; T3V-A68S-T77N-T78I-G99S-G127S-A128P-G165Q-T210P-A242G-S258P; T3V-A68S-T77N-T78I-G99S-M123I-G127S-A128P-G165Q-N184Q-A202V-T210P-N217S-A242G-S258D; I35A-M123I-G127T-T210P-S2431; T3V-A68S-T77N-G99S-M123I-G127S-A128P-G165Q-N184Q-A202V-N217S-S258P-F260W: T3V-A68S-T77N-T78I-G99S-G101A-G127S-A128P-G165Q-T210P-A242G-S258P; A68S-T77N-G99Q-A128P-G165Q-N184Q-N217S; A68S-T77N-A128P-G165Q-N184Q-A202V-N217S; A68S-T77N-A128P-G165Q-N184Q-N217S-S258D; T3V-A68S-T77N-T78I-G99S-G101A-M123I-G127S-A128P-G165Q-N184Q-A202V-T210P-N217S-A242G-S258P; and V45R-S98R; with the proviso that one or more of said two, three, or four or more substitutions is a man-made substitution; wherein said variant has at least 85% but less than 100% amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5. Motif 6, Motif 7, Motif 8, Motif 9, Motif 10. Motif 11, Motif 12, Motif 13, and Motif 14; and wherein the amino acid positions of the variant are numbered by correspondence with the amino acid sequence of SEQ ID NO:2.

Another embodiment provides one or more subtilisin variant comprising an amino acid sequence comprising one or more amino acid substitution sets selected from: M123-Q136R; P9E-M1231; V45R-M123I; G127T-G165S-T210E; M123I-G165S-N239S; M123I-Q136R-G165Q; M123I-Q136R-S258E; M123I-V146S-T210E; P9E-V45R-M123I; Q136R-G165Q-S258E; V45R-M123I-Q136R; G127T-V146S-G165S-N239S; L10M-K27R-S98H-M123I; M231-Q136R-G165Q-S258E; M123I-V146S-G165S-T210P; M123I-V146S-T210P-S250G; P9E-M123I-Q136R-G165Q: P9E-Q136R-G165Q-S258E; P9E-V45R-M123I-Q136R; V45R-M123I-Q136R-G165Q; V45R-M123I-Q136R-S258E; V45R-Q136R-G165Q-S258E; K27R-N43A-S98H-M123I-T210H; P9E-M123I-Q136R-G165Q-S258E; P9E-V45R-M123I-Q136R-G165Q; P9E-V45R-M123I-Q136R-S258E; V45R-M123I-Q136R-G165Q-S258E; Y103I-G127T-V146S-G165S-N239S; T77H-V87T-M123I-Q136R-N184Q-N239S; V26R-V45R-S98R-E1 1Q-M123I-Q136R; T77H-V87T-M123I-Q136R-G165Q-N184Q-N239S; T77S-V87S-M123I-Q136R-G165Q-S187P-S258P; T77S-V87S-M123I-Q136R-N160C-S187P-S258P; T77H-V87T-M123I-Q136R-N184Q-S187P-N239S-S258P; T3Q-K22Y-A24N-V45I-A481-T77N-N217S-L2341-Y255R P9E-T77Q-V87T-M1231-Q136R-G165Q-N184Q-N217S-N239S-S258E: N43A-V45R-T77H-V87T-M123I-Q136R-G165A-N184Q-S187P-N239S-S258P; P9E-N43A-V45R-T77S-V87S-M123I-Q136R-G165Q-S187P-N217S-S258P; P9E-N43A-V45R-T77H-V87T-M123I-Q136R-G165Q-N184Q-S187P-N239S-S258P; P9E-N43A-V45R-T77Q-V87T-M123I-Q136R-G165Q-N184Q-N217S-N239S-S258E: P9E-N43A-V45R-T77H-V87T-M123I-Q36R-G165A-N184Q-S187P-N217S-N239S-S258E: T77N-N217S-L234W; T77N-N217S, T77N-G126Q-G165Q-T210P-N217S-L234W-S258P, T77N-G127F-G165Q-A202V-T210P-N217S-L234W-S258P; A1Q-T3V-V28A-I35A-A68S-T77N-S86H-T115F-N217S-N239S-S250G-S258P-Q274A; T77N-M123I-T210P-N239S-S250G-S258P; V45I-A68S-T77N-M123I-L125N-G165Q-N217S-S258P; A68S-V71A-T77N-L95A-G165Q-N184Q-T210P-S258P; M123I-T210P-N217S-S258P; G127F-G165Q-N217S-S258P; T77N-G165Q-N217S-S258P; T77S-G165A-N184Q-T210P-N217S; A68S-T77N-A128P-G165Q-N184Q-N217S; V71A-T77S-N184Q-S258P; T77N-M123I-G165Q-N184Q-N217S; V71A-L95A-A128S-T210P; V71A-M123I-A128S-T210P; V71A-M123I-A128S-G165E: T77S-A128P-N184Q-N217S-F260W; T77H-A128S-G165Q-T210P; T77D-S86R-S155E-G165A-N184Q; A68S-V71A-T77N-A128S-G165Q-T210P-N217S; V28A-I35A-A68S-T77N-A128S-G165Q-N184Q-G203N-T210P; A128P-T210P; T210P-S258P; A128P-T210P-S259P; A128P-S187P-T210P; A128P-S187P-T210P-S258P; P9E-T77S-V87T-T210P-N239K; K15I-L95Q-M123I-G165S-T210P-N217S; K15I-M123I-V146S-G165S-T210P-N239S: K15I-N76K-M123I-V146S-G165S-T210P-N239S; K15I-V146S-G165S-T210P-N239S; P009E-V146S-N184Q-G203E-T210P-P238R-N239S; M123I-G165S-N217S; K15I-L95Q-S108K-G165S-G203E-T210P-N217S; K15I-L95Q-S108K-G165S-G203E-T210P; P9E-K15I-G165S-A193D-G203E-T210P; T77N-M123I-G165Q-N217S; T77H-G165Q; T77N-G165Q-N217S; A68S-V71A-T77N-G165Q-N217S; T77N-V87S-M123I-S155G-G165Q-N217S; T77H-V87S-S155G-G165Q: T77N-V87S-S155G-G165Q-N217S; T77N-M123I-G165Q; T77N-G165Q; A68S-V71A-T77N-G165Q; T77N-V87S-M123I-S155G-G165Q; I35A-A68S-T77N-V87S-V147L-G165Q; A68S-T77N-V87S-V147L-S155E-G165Q; T77N-V87S-M123I-V147L-S155G-G165Q; A68S-T77N-M123I-G165Q-N184Q-N217S; T77N-M123I-A128P-G165Q-N184Q-N217S; A68S-V71A-T77N-S100N-A 128P-G165Q-N184Q-T210P-N217S-N239T; T77N-A128P-G165Q-N184Q-N217S; A68S-A128P-G165Q-N184Q-N217S; A68S-T77N-G165Q-N184Q-N217S; A68S-T77N-A128P-N184Q-N217S; A68S-T77N-A128P-G165Q-N217S; A68S-T77N-A128P-G165Q-N184Q; M123I-G165Q-N184Q-N217S; T77N-G165Q-N184Q-N217S: T77N-M123I-N184Q-N217S; T77N-M123-G165Q-N184Q; T3V-A68S-T77N-A128P-G165Q-N184Q-N217S; T3V-A68S-T77N-M123I-A128P-G165Q-N184Q-N217S; T3V-T77N-M123I-G165Q-N184Q-N217S; A68S-T77N-S108H-A128P-G165Q-N184Q-N217S; A68S-T77N-G99S-A128P-G165Q-N184Q-N217S; A68S-T77N-T14N-A128P-G165Q-N184Q-N217S; A68S-T77N-M123I-A128P-G165Q-N184Q-N217S; A68S-T77N-G127T-A128P-G165Q-N184Q-N217S; A68S-T77N-A128P-G165Q-N184Q-T210P-N217S; A68S-T77N-G99S-M123I-A128P-G165Q-N184Q-N217S; A68S-T77N-G99S-G127T-A128P-G165Q-N184Q-N217S; A68S-T77N-G99S-A128P-G65Q-N184Q-T210P-N217S; A68S-T77N-T14N-M123I-A128P-G165Q-N184Q-N217S; A68S-T77N-T114N-G127T-A128P-G165Q-N184Q-N217S; A68S-T77N-T114N-A128P-G165Q-N184Q-T210P-N217S; A68S-T77N-M123I-G127T-A128P-G165Q-N184Q-N217S; A68S-T77N-M123I-A128P-G165Q-N184Q-T210P-N217S; A68S-T77N-G127T-A128P-G165Q-N184Q-

T210P-N217S; A68S-T77N-G99S-M123I-A128P-G165Q-N184Q-T210P-N217S; A68S-T77N-M123I-G127T-A128P-G165Q-N184Q-T210P-N217S; T3V-A68S-T77N-G99S-M123I-A128P-G165Q-N184Q-N217S; T3V-A68S-T77N-T114N-M123I-A128P-G165Q-N184Q-N217S; T3V-A68S-T77N-M123I-G127T-A128P-G165Q-N184Q-N217S; T3V-A68S-T77N-M123I-A128P-G165Q-N184Q-T210P-N217S; S86H-T115F-A143V-G65Q-A202V-S258P; S86H-L95A-N184Q-A202V-T210P-N217S-L234W-S250G-S258P; V30T-I35A-T77N-G165Q-A202V-T210P-S250G-S258P; A1Q-T3V-35A-T77N-T78I-S86H-T15F-G165Q-N184Q-N217S-L234V-S258P; A1Q-A37T-T77N-T78I-S86H-M123I-G165Q-N184Q-A202V-N239S-S250G-S258P-Q274A; P9E-T77N-N96S-G165Q-G203E-S250G; P9E-T77N-N96S-G165E-G203E-T210P-S250G; A1Q-T3V-S86H-G130S-S155G-G165Q-N184Q-A202V-G203N-T210P-Q274A; A1Q-T3V-S86H-G165Q-N184Q-N239S-S250G-S258P; A1Q-T77N-S86H-V147L-A151G-N184Q-N217S-S258P; S86H-T115F-S155G-G165Q-N184Q-A202V-Q274A; A68S-S86H-T115F-N184Q-A202V-G203N-N239S-S250G-S258P-Q274A; A68S-T77N-V87S-A128P-S155G-G165Q-N217S; A68S-T77N-A128P-G165Q; A68S-T77N-V87S-A128P-S155G-G165Q; I35A-A68S-T77N-V87S-A128P-V147L-G65Q-N217S; A68S-T77N-V87S-A128P-S155G-G165Q-N217S-A242G: A68S-T77N-V87S-A128P-V147L-S155E-G165Q; A68S-T77N-V87S-A128P-S155E-G165Q-N217S; A68S-T77N-S86N-V87S-A128P-S155G-G165Q-N217S-A242G; I35A-A68S-T77N-A128P-V147L-G165Q-N217S; I35A-A68S-T77N-A128P-S155G-G165Q-A242G; I35A-A68S-T77N-A128P-V147L-G165Q-A242G; A68S-T77N-V87S-A128P-S155G-G165Q-A242G; A068S-T077N-N086S-G165Q-K194E-S211N-N217S; A068S-T077N-N086S-V087S-S155G-G165Q-K194E-S211N-N217S; A068S-T077N-N086S-G165Q-K194E-S211N; A068S-T077N-N086S-V087S-S155G-G165Q-K194E-S211N; 1035A-A068S-T077N-N086S-V087S-V147L-G165Q-K194E-S211N-N217S; A068S-T077N-N086S-V087S-S155G-G165Q-K194E-S211N-N217S-A242G; A068S-T077N-N086S-V087S-V147L-S155E-G165Q-K194E-S211N; A068S-T077N-N086S-V087S-S155E-G165Q-K194E-S211N-N217S; A068S-T077N-V087S-S155G-G165Q-K194E-S211N-N217S-A242G; I035A-A068S-T077N-N086S-V147L-G165Q-K194E-S211N-N217S; I035A-A068S-T077N-N086S-S155G-G165Q-K194E-S211N-A242G0135A-A068S-T077N-N086S-V147L-G165Q-K194E-S211N-A242G; and A068S-T077N-N086S-V087S-S155G-G165Q-K194E-S211N-A242G: with the proviso that one or more of said two, three, or four or more variations is a non-naturally occurring amino acid; wherein said variant has 85% or more amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

Yet an even still further embodiment is directed to one or more subtilisin variant comprising an amino acid sequence comprising one or more amino acid substitution sets selected from: A68S-T77N-G127T-A128P-G165Q-N184Q-A202V-N217S; T3V-A68S-T77N-M123I-A128P-G165Q-N184Q-A202V-N217S; A68S-T77N-G127T-A128P-G165Q-N184Q-N217S-S258P; T3V-A68S-T77N-M123I-A128P-G165Q-N184Q-N217S-S258P; A68S-T77N-G127T-A128P-G165Q-N184Q-G203Q-N217S; T3V-A68S-T77N-M123I-A128P-165Q-N184Q-G203Q-N217S; A68S-T77N-A128P-G165Q-N184Q-A202V-N217S-S258P; T3V-A68S-T77N-M123I-A128P-G165Q-N184Q-A202V-N217S-S258P; A68S-T77N-A128P-G165Q-N184Q-G203Q-N217S-S258P; T3V-A68S-T77N-M123I-A128P-G165Q-N184Q-G203Q-N217S-S258P; S86H-T115F-G127T-A143V-G165Q-N184Q-A202V-N217S-S258P; T3V-S86H-T115F-M123I-A143V-G165Q-A202V-N217S-S258P; A68S-T77N-A128P-S129H-G165Q-N184Q-A202V-N217S: T3V-A68S-T77N-M123I-A128P-S129H-G165Q-N184Q-A202V-N217S; S86H-T115F-S129H-A143V-G165Q-N184Q-A202V-N217S-S258P; T3V-S86H-T15F-M123I-S129H-A143V-G165Q-A202V-N217S-S258P; A68S-T77N-A128P-S155N-G165Q-N184Q-A202V-N217S; T3V-A68S-T77N-M123I-A128P-S155N-G165Q-N184Q-A202V-N217S; I35A-A68S-T77N-V87S-A128P-V147L-G165Q-A202V-N217S; T3V-I35A-A68S-T77N-V87S-M123I-A128P-V147L-G165Q-A202V-N217S; A68S-T77N-A128P-Q136N-S155N-G165Q-N184Q-N217S-A242N; T3V-A68S-T77N-M123I-A128P-Q136N-S155N-G165Q-N184Q-N217S-A242N; A68S-V71A-T77N-A128P-G165Q-N184Q-A202V-N217S; T3V-A68S-V71A-T77N-M123I-A128P-G165Q-N184Q-A202V-N217S; A68S-T77N-A128P-G165Q-N184Q-S187P-A202V-N217S; T3V-A68S-T77N-M123I-A128P-G165Q-N184Q-S187P-A202V-N217S; A68S-T77N-A128R-G165Q-N184Q-A202V-N217S-S258D: T3V-A68S-T77N-M123I-A128R-G165Q-N184Q-A202V-N217S-S258D; A68S-T77N-A128P-S129R-G165Q-N184Q-N217S-S258D T3V-A68S-T77N-M123I-A128P-S129R-G165Q-N184Q-N217S-S258D; A68S-T77N-A128R-G165Q-N184Q-A202V-N217S-S258D-K264H; T3V-A68S-T77N-M123I-A128R-G165Q-N184Q-A202V-N217S-S258D-K264H; A68S-T77N-A128R-G165Q-N184Q-G203E-S258D; T3V-A68S-T77N-M123I-A128R-G165Q-N184Q-G203E-S258D; T3V-A68S-T77N-M123I-A128R-G165Q-N184E-A202V-N217S-S258D: T3V-A52R-A68S-T77N-M123I-A128R-G165Q-N184E-A202V-N217S-S258D: T3V-T77N-S100N-G105N-D119Q-A128P-S158N-N160D-T161Q-G165A-N184Q-N217S-S258P-K264S; T3V-T77N-S100N-105N-A128P-S158D-T161Q-G165A-N184Q-N217S-S258P; T3V-T77N-S100N-G105N-A128P-S158N-N160D-T161Q-G165A-N184Q-N217S-S258P; A24Q-V45I-A68S-T77N-S98R-E111Q-M123I-S158Q-G165E-N184Q-S187E-V204I-T210I-N217S-S259E; P9E-A52R-S86R-E111Q-S129R-S158Q-G165E-V204I-T210I-S258D-S259E-K264Q: T3V-A68S-T77N-G127T-A128P-G165Q-N184Q-A202V-N217S: T3V-35A-T77N-V87S-M123I-A128P-G165Q-N184Q-A202V-N217S-A242G; T3V-A68S-T77N-G127E-A128P-G165Q-N184Q-A202V-N217S; T3V-A68S-T77N-M123I-G127V-A128P-G165Q-N184Q-N217S; T3V-A68S-T77N-M123I-A128P-A151G-G165Q-N184Q-N217S: T3V-A68S-T77N-G127T-A128P-A151G-G165Q-N184Q-N217S T3V-T77N-M123I-A128P-A151G-G165Q-N184Q-A202V-N217S; T3V-A68S-T77N-L95F-A128P-G165Q-N184Q-A202V-N217S; T3V-A68S-T77N-L95A-M123I-A128P-G165Q-N184Q-N217S; T3V-A68S-T77N-L95F-M123I-A128P-G165Q-N184Q-N217S: T3V-A68S-T77N-G99A-A128P-G165Q-N184Q-A202V-N217S; T3V-A68S-T77N-G99E-A128P-G165Q-N184Q-A202V-N217S; T3V-A68S-T77N-G99Q-A128P-G165Q-N184Q-A202V-N217S; T3V-A68S-T77N-G99A-M123I-A128P-G165Q-N184Q-N217S: T3V-A68S-T77N-S108H-A 128P-G165Q-N184Q-N217S; T3V-I35A-T77N-V87S-M123I-A128P-V146A-G165Q-N184Q-A202V-N217S-A242G; T3V-A68S-T77N-G127T-A128P-G165E-N184Q-A202V-N217S; T3V-A68S-T77N-M123I-A128P-V146A-G165Q-

N184Q-N217S; T3V-A68S-T77N-M123I-A128P-T161D-G165Q-N184Q-A202V-N217S; T3V-V45R-A68S-T77N-S102D-A128P-T161D-G165Q-N184Q-A202V-N217S; T3V-A68S-T77N-G127T-A128P-G165Q-N184Q-A202V-N217S-S258P; T3V-A68S-T77N-M123I-G127T-A128P-G165Q-N184Q-A202V-N217S-S258P; T3V-A68S-T77N-M123I-G127V-A128P-G165Q-N184Q-A202V-N217S-S258P; T3V-A68S-T77N-M123I-G127S-A128P-G165Q-N184Q-A202V-N217S-S258P; T3V-I35A-T77N-V87S-G127T-A128P-G165Q-N184Q-A202V-N217S-A242G-S258P; T3V-T77N-M123I-G127Q-A128P-G165Q-N184Q-A202V-N217S-S258P; T3V-T77N-M123I-G127V-A128P-G165Q-N184Q-A202V-N217S-S258P; T3V-T77N-M123I-G127E-A128P-G165Q-N184Q-A202V-N217S-S258P; T3V-A68S-T77N-M123I-G127T-A128P-G165Q-N184Q-A202V-N217S; T3V-A68S-T77N-M123I-G127T-A128P-G165Q-N184Q-A202V-T210P-N217S; T3V-A68S-T77N-M123I-A128P-G165Q-N184Q-A202V-T210P-N217S-S258P; T3V-A68S-T77N-M123I-G127T-A128P-G165Q-N184Q-A202V-N217S-S258D; L10M-I35A-T78I-V87S-M123I-A202V-S258D-F260W: L10M-35A-T78I-V87S-M123I-A202V-F260W-K264H; L10M-I35A-T78I-V87S-A202V-S258D; L10M-I35A-T78I-V87S-S187E-A202V; L10M-T78I-V87S-S187E-A202V; L10M-I35A-T78I-S187E-A202V; T3V-L10M-A68S-T77N-M123I-G127S-A128P-G165Q-N184Q-A202V-N217S-S258P; T3V-I35A-A68S-T77N-M123I-G127S-A128P-G165Q-N184Q-A202V-N217S-S258P; T3V-A68S-T77N-T78I-M123I-G127S-A128P-G165Q-N184Q-A202V-N217S-S258P; T3V-A68S-T77N-V87S-M123I-G127S-A128P-G165Q-N184Q-A202V-N217S-S258P; T3V-A68S-T77N-M123I-G127S-A128P-G165E-N184Q-A202V-N217S-S258P; T3V-A68S-T77N-M123I-G127S-A128P-G165Q-N184Q-A202V-T210P-N217S-S258P; T3V-A68S-T77N-M123I-G127S-A128P-G165Q-N184Q-A202V-L216Q-N217S-S258P; T3V-A68S-T77N-M123I-G127S-A128P-G165Q-N184Q-A202V-N217S-A242G-S258P; T3V-A68S-T77N-M123I-G127S-A128P-G165Q-N184Q-A202V-N217S-S258D; T3V-A68S-T77N-M123I-G127S-A128P-G165Q-N184Q-A202V-N217S-S258P-F260W; A68S-T77N-M123I-G127S-A128P-G165Q-N184Q-A202V-N217S-S258P; T3V-A68S-T77N-G127S-A128P-G165Q-N184Q-A202V-N217S-S258P; T3V-L31I-A68S-T77N-M123I-G127S-A128P-G165Q-N184Q-A202V-N217S-S258P; A68S-T77N-G127S-A128P-G165Q-N184Q-A202V-N217S-S258P; A68S-T77N-G127S-A128P-G165Q-N184Q-A202V-T210P-N217S-S258P; A68S-T77N-G127T-A128P-G165Q-N184Q-A202V-N217S-S258P; T3V-A68S-T77N-T78I-M123I-G127S-A128P-G165Q-N184Q-A202V-N217S-S258D; A68S-T77N-T78I-M123I-G127S-A128P-G165Q-N184Q-A202V-N217S-S258D; T3V-A68S-T77N-T78I-G127S-A128P-G165Q-N184Q-A202V-N217S-S258P; A68S-T77N-T78I-G127S-A128P-G165Q-N184Q-A202V-N217S-S258P; T3V-A68S-T77N-G127S-A128P-G165Q-N184Q-A202V-N217S-S258D; A68S-T77N-G127S-A128P-G165Q-N184Q-A202V-N217S-S258D; T3V-A68S-T77N-T78I-G127S-A128P-G65Q-N184Q-A202V-N217S-S258D; A68S-T77N-T78I-G127S-A128P-G165Q-N184Q-A202V-N217S-S258D; T3V-A68S-T77N-S108H-G127S-A128P-G165Q-N184Q-A202V-N217S-S258P; T3V-A68S-T77N-G99Q-A128P-G165Q-N184Q-A202V-N217S-S258P; T3V-A68S-T77N-G99Q-A128P-G165Q-N184Q-A202V-T210P-N217S-S258P; T3V-A68S-T77N-G127S-A128P-G165E-N184Q-A202V-N217S-S258P; T3V-A68S-T77N-G127S-A128P-G165Q-N184Q-A202V-T210P-N217S-S258P; T3V-P9E-A68S-T77N-M123I-G127S-A128P-G165Q-N184Q-A202V-T210P-N217S-S258P; T3V-A68S-T77N-M123I-G127S-A128P-G165Q-N184Q-S187E-A202V-T210P-N217S-S258P; T3V-A68S-T77N-M123I-G127S-A128P-G165Q-N184Q-A202V-G203E-T210P-N217S-S258P; T3V-L10M-A68S-T77N-M123I-G127S-A128P-G165Q-N184Q-A202V-T210P-N217S-S258P; T3V-P9E-A68S-T77N-M123I-G127S-A128P-G165Q-N184Q-A202V-N217S-S258P; T3V-A68S-T77N-M123I-G127S-A128P-G165Q-N184Q-S187E-A202V-N217S-S258P; T3V-P9E-A68S-T77N-G127S-A128P-G165Q-N184Q-A202V-T210P-N217S-S258P; T3V-A68S-T77N-G127S-A128P-G165Q-N184Q-S187E-A202V-T210P-N217S-S258P; T3V-A68S-T77N-G127S-A128P-G165Q-N184Q-A202V-G203E-T210P-N217S-S258P; T3V-A68S-T77N-G01A-G127S-A128P-G165Q-N184Q-A202V-T210P-N217S-S258P; T3V-L10M-A68S-T77N-G127S-A128P-G165Q-N184Q-A202V-T210P-N217S-S258P; T3V-P9E-A68S-T77N-M123I-A128P-G165Q-N184Q-A202V-T210P-N217S-S258P; T3V-A68S-T77N-M123I-A128P-G165Q-N184Q-S187E-A202V-T210P-N217S-S258P; T3V-A68S-T77N-M123I-A128P-G65Q-N184Q-A202V-G203E-T210P-N217S-S258P; T3V-A68S-T77N-G101A-M123I-A128P-G165Q-N184Q-A202V-T210P-N217S-S258P; T3V-L10M-A68S-T77N-M123I-A128P-G165Q-N184Q-A202V-T210P-N217S-S258P; T3V-L10M-A68S-T77N-G101A-M123I-G127S-A128P-G165Q-N184Q-A202V-T210P-N217S-S258P; T3V-P9E-L10M-A68S-T77N-M123I-G127S-A128P-G165Q-N184Q-A202V-T210P-N217S-S258P; T3V-P9E-A68S-T77N-G99Q-A128P-G165Q-N184Q-A202V-T210P-N217S-S258P; T3V-A68S-T77N-M123I-G127S-A128P-G165Q-N184Q-A202V-T210P-N217S-S243I-S258P; T3V-A68S-M123I-G127S-A128P-G165Q-N184Q-A202V-N217S-S258P; T3V-A68S-T77N-M123I-G127S-A128P-N184Q-A202V-N217S-S258P; T3V-A68S-T77N-M123I-G127S-A128P-G165Q-A202V-N217S-S258P; T3V-A68S-T77N-M123I-G127S-A128P-G165Q-N184Q-A202V-S258P; T3V-A68S-T77E-M123I-G127T-A128P-G165Q-N184Q-A202V-N217S-S258P; T3V-A68S-T77E-M123I-G127S-A128P-G165Q-N184Q-A202V-N217S-S258P; T3V-A68S-T77N-M123I-G127S-A128P-G165Q-N184Q-A202V-N217S-S258P-K264H; T3V-A68S-T77N-S102T-M123I-G127S-A128P-G165Q-N184Q-A202V-N211S-N217S-S258P; T3V-A68S-T77N-M123I-G127S-A128P-G165Q-N184Q-A202V-N21 S-N217S-S258P; T3V-A68S-T77N-S102T-M123I-G127S-A128P-G65Q-N184Q-A202V-N217S-S258P; T3V-A68S-T77N-M123I-G127S-A128P-G165Q-N184Q-A202V-N217S-S258P-S259P; T3V-A68S-T77N-M123I-G127S-A128P-T161Q-G165Q-N184Q-A202V-N217S-S258P; T3V-A68S-T77N-M123I-G127S-A128P-S158Q-G165Q-N184Q-A202V-N217S-S258P; T3V-V45Q-A68S-T77N-M123I-G127S-A128P-G165Q-N184Q-A202V-N217S-S258P; T3V-A68S-T77N-M123I-G127S-A 128P-G165Q-N184Q-A193Q-A202V-N217S-S258P; T3V-A68S-T77N-M123I-G127S-A128P-A143Q-G165Q-N184Q-A202V-N217S-S258P; T3V-A68S-T77N-G117S-M123I-G127S-A128P-G165Q-N184Q-A202V-N217S-S258P; T3V-A48V-A68S-T77N-M123I-G127S-A128P-G165Q-N184Q-A202V-N217S-S258P; T3V-A48T-A68S-T77N-M123I-G127S-A128P-G165Q-N184Q-A202V-N217S-S258P; T3V-A29S-A68S-T77N-M123I-G127S-A128P-G165Q-N184Q-A202V-N217S-S258P; T3V-A68S-T77N-G127S-A128P-G165Q-N184Q-A202V-N217S; T3V-A68S-T77N-G127S-A128P-G165Q-N184Q-N217S-S258P; T3V-A68S-T77N-A128P-G165Q-N184Q-A202V-N217S-S258P; A68S-T77N-M123I-G127S-A128P-G165Q-N184Q-A202V-N217S; A68S-T77N-M123I-A128P-G165Q-N184Q-

A202V-N217S-S258P; T3V-A68S-T77N-G99Q-G127S-A128P-G165Q-N184Q-A202V-N217S-S258P; T3V-A68S-T77N-T78I-V87S-M123I-G127S-A128P-G165Q-N184Q-A202V-T210P-N217S-S258P; T3V-A68S-T77N-T78I-M123I-G127S-A128P-G165Q-N184Q-A202V-T210P-N217S-A242G-S258P; T3V-V26Q-A68S-T77N-M123I-G127S-A128P-G165E-N184Q-A202V-T210P-N217S-S258P; T3V-P9E-L10M-A68S-T77N-M123I-G127S-A128P-G165E-N184Q-A202V-T210P-N217S-S258P; T3V-P9E-L10M-A68S-T77N-G101A-M123I-G127S-A128P-G165Q-N184Q-A202V-N217S-S258P; T3V-A68S-T77N-T78I-M123I-G127S-A128P-G165Q-N184Q-A202V-T210P-N217S-S258P; T3V-A68S-T77N-T78I-M123I-G127S-A128P-N160K-G165Q-N184Q-A202V-T210P-N217S-A242G-S258P; T3V-A68S-T77N-V87S-M123I-G127S-A128P-G165Q-N184Q-A202V-T210P-N217S-S258P; T3V-P40E-A68S-T77N-M123I-G127S-A128P-G165Q-N184Q-A202V-N217S-S258P; T3V-A68S-T77E-M123I-G127T-A128P-G165E-N184Q-A202V-N217S-P238Q-S258P; T3V-A68S-T77N-G99S-M123I-G127S-A128P-G165Q-N184Q-A202V-N217S-S258P; T3V-A68S-T77E-M123I-G127T-G165E-N184Q-A202V-N217S-S258P; A68S-T77N-A128P-G165Q-N184Q-N217S-S258P; T3V-A68S-T77N-G101A-S102T-M123I-G127S-A128P-G165Q-N184Q-A202V-N217S-S258P; T3V-A68S-T77N-M123I-G127S-A128P-G165Q-N184Q-A202V-N217S; T3V-A68S-T77N-T78I-G99S-G127S-A128P-G165Q-T210P-A242G-S258P-K264H; T3V-A68S-T77N-T78I-G99S-M123I-G127S-A128P-G165Q-N184Q-A202V-T210P-N217S-A242G-S258P; T3V-A68S-T77N-M123I-G127T-G165E-N184Q-A202V-N217S-P238Q-S258P; T3V-A68S-T77N-T78I-G99S-G127S-A128P-G165Q-T210P-A242G-S258P; T3V-A68S-T77N-T78I-G99S-M123I-G127S-A128P-G165Q-N184Q-A202V-T210P-N217S-A242G-S258D; I35A-M123I-G127T-T210P-S2431; T3V-A68S-T77N-G99S-M123I-G127S-A128P-G165Q-N184Q-A202V-N217S-S258P-F260W; T3V-A68S-T77N-T78I-G99S-G101A-G127S-A128P-G165Q-T210P-A242G-S258P; A68S-T77N-G99Q-A128P-G165Q-N184Q-N217S; A68S-T77N-A128P-G165Q-N184Q-A202V-N217S; A68S-T77N-A128P-G165Q-N184Q-N217S-S258D; T3V-A68S-T77N-T78I-G99S-G101A-M123I-G127S-A128P-G165Q-N184Q-A202V-T210P-N217S-A242G-S258P; and V45R-S98R; with the proviso that one or more of said two, three, or four or more substitutions is a man-made substitution; wherein said variant has at least 85% but less than 100% amino acid sequence identity to an AprL-Clade subtilisin enzyme comprising a Motif A and/or a Motif B; wherein Motif A is selected from Motif 1, Motif 2, Motif 3, and Motif 4; wherein Motif B is selected from Motif 5, Motif 6, Motif 7, Motif 8, Motif 9, Motif 10, Motif 11, Motif 12, Motif 13, and Motif 14; and wherein the amino acid positions of the variant are numbered by correspondence with the amino acid sequence of SEQ ID NO:2.

In a further embodiment, one or more subtilisin variant described herein further comprises one or more substitution selected from: 3T, 4I, 9R, 15T, 67A, 75D, 86S, 97S, 98A/D/G, 100G/M/R, 102A, 103N/Y, 105A, 117RV, 119D/N, 122S, 127L, 128Q, 129A, 159D, 166A, 169S, 193P, 194E, 198M, 216D, 217D, 221S, 231V, 234L, 235H, 244R, 251K, and 273A, and/or one or more insertion selected from a D inserted at position 36, an E inserted at position 96, and a D inserted between positions 98 and 99, wherein the amino acid positions of the variant are numbered by correspondence with the amino acid sequence of SEQ ID NO:2.

In one embodiment one or more subtilisin variant described herein is from a parent with 70%. 75%, 80%, 85%, 86%, 87%, 88%, 89%, 90%, 91%, 92%, 93%, 94%, 95%, 96%, 97%, 98%, 99%, or 100% amino acid sequence identity to an AprL-Clade subtilisin enzyme comprising a Motif A, Motif B, or a combination thereof. In another embodiment, one or more subtilisin variant described herein is from a parent with 89%, 90%, 91%, 92%, 93%, 94%, 95%, 96%, 97%, 98%, 99%, or 100% amino acid sequence identity to an AprL-Clade subtilisin enzyme comprising a Motif A, Motif B, or a combination thereof. In yet still another embodiment, one or more subtilisin variant described herein is from a parent with 70%, 75%, 80%, 85%, 86%, 87%, 88%, 89%, 90%, 91%, 92%, 93%, 94%, 95%, 96%, 97%, 98%, 99%, or 100% amino acid sequence identity to an AprL-Clade subtilisin enzyme comprising a Motif A and Motif B. In an even further embodiment, one or more subtilisin variant described herein is from a parent with 89%, 90%, 91%, 92%, 93%, 94%, 95%, 96%, 97%, 98%, 99%, or 100% amino acid sequence identity to an AprL-Clade subtilisin enzyme comprising a Motif A and a Motif B. The AprL-clade of subtilisin enzymes is more fully described in International Patent Application No. PCT/US16/32514, filed May 13, 2016. In some embodiments, the AprL-Clade subtilisin enzyme is selected from one of the enzymes listed in FIG. 1. In another embodiment, the AprL-Clade subtilisin enzyme comprises an amino acid sequence of SEQ ID NO:2, 9, 180, 181, 182, 183, 184, 185, 186, 187, 188, 189, 190, 191, 192, 193, 194, 195, 196, 197, 198, 199, 200, 201, 202, 203, 204, or 205. In still another embodiment, the AprL-Clade subtilisin enzyme comprises an amino acid sequence of SEQ ID NO:2, 9, 189, 198, 202, 203, or 205. In still another embodiment, the AprL-Clade subtilisin enzyme comprises an amino acid sequence of SEQ ID NO:2 or 9.

In one embodiment, the AprL-clade enzymes comprise Motif A. Motif B, or a combination thereof. In other embodiments, the AprL-clade enzymes comprise Motif A and Motif B. In some embodiments, one or more subtilisin variant described herein comprises Motif A, Motif B, or a combination thereof. In still other embodiments, one or more subtilisin variant described herein comprises Motif A and Motif B. In another embodiment, Motif A is selected from Motif 1, Motif 2, Motif 3, and Motif 4. In a still further embodiment, Motif B is selected from Motif 5, Motif 6, Motif 7, Motif 8, Motif 9, Motif 10, Motif 11, Motif 12, Motif 13, and Motif 14. In still other embodiments, the AprL-clade enzymes comprise Motif 1 between Asp32 and His63, wherein the amino acid positions are numbered by correspondence with the amino acid sequence of SEQ ID NO:2. In even still other embodiments, the AprL-clade enzymes comprise Motif 6 or Motif 7 between Lys236 and Arg246, wherein the amino acid positions are numbered by correspondence with the amino acid sequence of SEQ ID NO:2. In yet still further embodiments, the AprL-clade enzymes comprise (i) Motif 1 between Asp32 and His63, and (ii) Motif 6 or Motif 7 between Lys236 and Arg246, wherein the amino acid positions are numbered by correspondence with the amino acid sequence of SEQ ID NO:2. In still even other embodiments, one or more subtilisin variant described herein comprises Motif 1 between Asp32 and His63, wherein the amino acid positions are numbered by correspondence with the amino acid sequence of SEQ ID NO:2. In yet still an even further embodiment, one or more subtilisin variant described herein comprises Motif 6 or Motif 7 between Lys236 and Arg246, wherein the amino acid positions are numbered by correspondence with the amino acid sequence of SEQ ID NO:2. In yet another embodiment, one or more subtilisin variant described herein comprises (i) Motif 1 between Asp32 and His63, and (ii) Motif 6 or Motif 7 between Lys236 and Arg246, wherein the amino acid positions are numbered by correspondence with the amino acid sequence of SEQ ID NO:2.

In some embodiments, the AprL-clade enzymes comprise a YNT (SEQ ID NO:166) motif ("Motif 1"). In other embodiments, the AprL-clade enzymes comprise a Y56N57T58 (SEQ ID NO:167) motif, wherein the amino acid positions are numbered by correspondence with the amino acid sequence of SEQ ID NO:2 ("Motif 2"). In further embodiments, the AprL-clade enzymes comprise an FVX$_1$GEX$_2$X$_3$YNT (SEQ ID NO:168) motif, wherein X$_1$ is A or S, X$_2$ is absent or any amino acid, and X$_3$ is A or S ("Motif 3"). In a still further embodiment, the AprL-clade enzymes comprise a F50V51X$_1$52G53E54X$_3$55Y56N57T58 (SEQ ID NO:169) motif, wherein X$_1$ is an A or S and X$_3$ is an A or S; and further wherein the amino acid positions are numbered by correspondence with the amino acid sequence of SEQ ID NO:2 ("Motif 4"). In some embodiments, the AprL-clade enzymes comprise a loop region between residues 52-60, wherein the amino acid positions are numbered by correspondence with the amino acid sequence of SEQ ID NO:2.

In other embodiments, the AprL-clade enzymes comprise an LSX$_4$S (SEQ ID NO:170) motif, wherein X$_4$ is A or G ("Motif 5"). In still other embodiments, the AprL-clade enzymes comprise an LSAS (SEQ ID NO:171) motif ("Motif 6"). In another embodiment, the AprL-clade enzymes comprise an LSGS (SEQ ID NO:172) motif ("Motif 7"). In some embodiments, the AprL-clade enzymes comprise an L240S241A242S243 (SEQ ID NO:173) motif, wherein the amino acid positions are numbered by correspondence with the amino acid sequence of SEQ ID NO:2 ("Motif 8"). In further embodiments, the AprL-clade enzymes comprise an L240S241G242S243 (SEQ ID NO:174) motif, wherein the amino acid positions are numbered by correspondence with the amino acid sequence of SEQ ID NO:2 ("Motif 9"). In still further embodiments, the AprL-clade enzymes comprise a KXXXLSX$_4$SQX$_5$R (SEQ ID NO:175) motif, wherein X is any amino acid, X$_4$ is A or G, and X$_5$ is an I or V ("Motif 10"). In yet further embodiments, the AprL-clade enzymes comprise a KXXXLSASQX$_5$R (SEQ ID NO:176) motif, wherein X is any amino acid and X$_5$ is an I or V ("Motif 11"). In an even yet further embodiment, the AprL-clade enzymes comprise a KXXXLSGSQXSR (SEQ ID NO:177) motif, wherein X is any amino acid and X$_5$ is an I or V ("Motif 12"). In still further embodiments, the AprL-clade enzymes comprise a K236XXXLSASQX$_5$R246 (SEQ ID NO:178) motif, wherein X is any amino acid and X$_5$ is an I or V; and further wherein the amino acid positions are numbered by correspondence with the amino acid sequence of SEQ ID NO:2 ("Motif 13"). In an even yet still further embodiment, the AprL-clade enzymes comprise a K236XXXLSGSQX$_5$R246 (SEQ ID NO:179) motif, wherein X is any amino acid and X$_5$ is an I or V; and further wherein the amino acid positions are numbered by correspondence with the amino acid sequence of SEQ ID NO:2 ("Motif 14").

In some embodiments, one or more subtilisin variant described herein comprises a YNT (SEQ ID NO:166) motif ("Motif 1"). In other embodiments, one or more subtilisin variant described herein comprise a Y56N57T58 (SEQ ID NO:167) motif, wherein the amino acid positions are numbered by correspondence with the amino acid sequence of SEQ ID NO:2 ("Motif 2"). In further embodiments, one or more subtilisin variant described herein comprises an FVX$_1$GEX$_2$X$_3$YNT (SEQ ID NO:168) motif, wherein X$_1$ is A or S, X$_2$ is absent or any amino acid, and X$_3$ is A or S ("Motif 3"). In a still further embodiment, one or more subtilisin variant described herein comprises a F50V51X$_1$52G53E54X$_3$55Y56N57T58 (SEQ ID NO:169) motif, wherein X$_1$ is an A or S and X$_3$ is an A or S; and further wherein the amino acid positions are numbered by correspondence with the amino acid sequence of SEQ ID NO:2 ("Motif 4"). In some embodiments, one or more subtilisin variant described herein comprises a loop region between residues 52-60, wherein the amino acid positions are numbered by correspondence with the amino acid sequence of SEQ ID NO:2.

In other embodiments, one or more subtilisin variant described herein comprises an LSX$_4$S (SEQ ID NO:170) motif, wherein X$_4$ is A or G ("Motif 5"). In still other embodiments, one or more subtilisin variant described herein comprises an LSAS (SEQ ID NO:171) motif ("Motif 6"). In another embodiment, one or more subtilisin variant described herein comprises an LSGS (SEQ ID NO:172) motif ("Motif 7"). In some embodiments, one or more subtilisin variant described herein comprises an L240S241A242S243 (SEQ ID NO:173) motif, wherein the amino acid positions are numbered by correspondence with the amino acid sequence of SEQ ID NO:2 ("Motif 8"). In further embodiments, one or more subtilisin variant described herein comprises an L240S241G242S243 (SEQ ID NO:174) motif, wherein the amino acid positions are numbered by correspondence with the amino acid sequence of SEQ ID NO:2 ("Motif 9"). In still further embodiments, one or more subtilisin variant described herein comprises a KXXXLSX$_4$SQX$_5$R (SEQ ID NO:175) motif, wherein X is any amino acid, X$_4$ is A or G, and X$_5$ is an 1 or V ("Motif 10"). In yet further embodiments, one or more subtilisin variant described herein comprises a KXXXLSASQX$_5$R (SEQ ID NO:176) motif, wherein X is any amino acid and X$_5$ is an I or V ("Motif 11"). In an even yet further embodiment, one or more subtilisin variant described herein comprises a KXXXLSGSQX$_5$R (SEQ ID NO:177) motif, wherein X is any amino acid and X$_5$ is an I or V ("Motif 12"). In still further embodiments, one or more subtilisin variant described herein comprises a K236XXXLSASQX$_5$R246 (SEQ ID NO:178) motif, wherein X is any amino acid and X$_5$ is an I or V; and further wherein the amino acid positions are numbered by correspondence with the amino acid sequence of SEQ ID NO:2 ("Motif 13"). In an even yet still further embodiment, one or more subtilisin variant described herein comprises a K236XXXLSGSQX$_5$R246 (SEQ ID NO:179) motif, wherein X is any amino acid and X$_5$ is an I or V; and further wherein the amino acid positions are numbered by correspondence with the amino acid sequence of SEQ ID NO:2 ("Motif 14").

In another embodiment, one or more subtilisin variant described herein comprise two, three, or four or more variations described herein versus SEQ ID NO:2 with the proviso (i) that said variations versus SEQ ID NO:2 are not an insertion or deletion; (ii) that the variation is not a proline when the amino acid sequence of said variant comprises a variation versus SEQ ID NO:2 at one or more of positions 37, 187, 193, and 258; (iii) that said variation is not 26R, 38S, 234R, or 250E/N when the amino acids sequence of said variant comprises a variation versus SEQ ID NO:2 at two or more of positions 26, 38, 234, and 250; and/or (iv) that said variation versus SEQ ID NO:2 is not at position 130 or 193 when the amino acid sequence of said variant comprises a variation at position 128; wherein the amino acid positions of the variant are numbered by correspondence with the amino acid sequence of SEQ ID NO:2.

In yet another embodiment, one or more subtilisin variant described herein comprise two, three, or four or more variations at positions corresponding to SEQ ID NO:2 described herein with the proviso (i) that said variations at positions corresponding to SEQ ID NO:2 are not an insertion or deletion; (ii) that the variation is not a proline when the amino acid sequence of said variant comprises a variation at one or more corresponding SEQ ID NO:2 positions selected from positions 37, 187, 193, and 258; (iii) that said variation is not 26R, 38S, 234R, or 250E/N when the amino acid sequence of said variant comprises a variation at two or more corresponding SEQ ID NO:2 positions selected from positions 26, 38, 234, and 250; (iv) that said variation at a position corresponding to SEQ ID NO:2 is not at position 130 or 193 when the amino acid sequence of said variant comprises a variation at position 128; and/or (v) that said variant does not consist of the amino acid sequence set forth as SEQ ID NO:5 in WO2016074925 or as SEQ ID NO:110 in JP201300714.

In still another embodiment, one or more subtilisin variant described herein comprises two, three, or four or more substitutions described herein with the proviso (i) that said substitution is not proline when that amino acid sequence of said variant comprises a substitution at one or more of positions 37, 187, 193, and 258; (ii) that said substitution is not 26R. 38S, 234R, or 250E/N when the amino acid sequence of said variant comprises a substitution at two or more of positions 26, 38, 234, and 250; and/or (iii) that said substitution is not at position 130 or 193 when the amino acid sequence of said variant comprises a substitution at position 128; wherein the amino acid positions of the variant are numbered by correspondence with the amino acid sequence of SEQ ID NO:2.

In yet another embodiment, one or more subtilisin variant described herein comprises two, three, or four or more substitutions described herein with the proviso (i) that said substitution is not proline when that amino acid sequence of said variant comprises a substitution at one or more of positions 37, 187, 193, and 258; (ii) that said substitution is not 26R. 38S, 234R, or 250E/N when the amino acid sequence of said variant comprises a substitution at two or more of positions 26, 38, 234, and 250; (iii) that said substitution is not at position 130 or 193 when the amino acid sequence of said variant comprises a substitution at position 128; and/or (iv) that said variant does not consist of the amino acid sequence set forth as SEQ ID NO:5 in WO2016074925 or as SEQ ID NO:110 in JP201300714.

In one embodiment, one or more subtilisin variant described herein comprises an amino acid sequence having at least 60%, at least 65%, at least 70%, at least 75%, at least 80%, at least 85%, at least 89%, at least 90%, at least 91%, at least 92%, at least 93%, at least 94%, at least 95%, at least 96%, at least 97%, at least 98%, at least 99% but less than 100% amino acid sequence identity to the amino acid sequence of an AprL-Clade subtilisin enzyme identified in FIG. 1. In some embodiments, one or more subtilisin variant described herein comprise an amino acid sequence having at least 60%, at least 65%, at least 70%, at least 75%, at least 80%, at least 85%, at least 89%, at least 90%, at least 91%, at least 92%, at least 93%, at least 94%, at least 95%, at least 96%, at least 97%, at least 98%, at least 99% but less than 100% amino acid sequence identity to the amino acid sequence of SEQ ID NO:2 or 9. In other embodiments, one or more subtilisin variant described herein comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99% but less than 100% amino acid sequence identity to the amino acid sequence of (i) an AprL-Clade subtilisin enzyme identified in FIG. 1, or (ii) SEQ ID NO: 2 or 9. In another embodiment, one or more subtilisin variant described herein comprises an amino acid sequence having at least 89% but less than 100% amino acid sequence identity to the amino acid sequence of an AprL-Clade subtilisin enzyme identified in FIG. 1. In other embodiments, one or more subtilisin variant described herein comprises an amino acid sequence having at least 89% but less than 100% amino acid sequence identity to the amino acid sequence of SEQ ID NO:2 or 9. In further embodiments, one or more subtilisin variant described herein comprises an amino acid sequence having at least 90% but less than 100% amino acid sequence identity to the amino acid sequence of an AprL-Clade subtilisin enzyme identified in FIG. 1. In some embodiments, one or more subtilisin variant described herein comprises an amino acid sequence having at least 90% but less than 100% amino acid sequence identity to the amino acid sequence of SEQ ID NO:2 or 9. In still other embodiments, one or more subtilisin variant described herein comprises an amino acid sequence having at least 95%, at least 96%, at least 97%, at least 98%, at least 99% but less than 100% amino acid sequence identity to the amino acid sequence of an AprL-Clade subtilisin enzyme identified in FIG. 1. In yet still other embodiments, one or more subtilisin variant described herein comprises an amino acid sequence having at least 95%, at least 96%, at least 97%, at least 98%, at least 99% but less than 100% amino acid sequence identity to the amino acid sequence of SEQ ID NO:2 or 9. In even still other embodiments, one or more subtilisin variant described herein is an isolated, recombinant, substantially pure, or non-naturally occurring subtilisin having subtilisin activity or casein hydrolysis activity (for example, dimethyl cascin hydrolysis activity).

In one embodiment, one or more subtilisin variant described herein has enzymatic activity (e.g., protease activity) and thus is useful in cleaning applications, including but not limited to, methods for cleaning dishware items, tableware items, fabrics, and items having hard surfaces (e.g., the hard surface of a table, table top, wall, furniture item, floor, ceiling, etc.). Exemplary cleaning compositions comprising one or more subtilisin variant described herein are described infra. The enzymatic activity (e.g., protease enzyme activity) of one or more subtilisin variant described herein can be determined readily using procedures well known to those of ordinary skill in the art. The Examples presented infra describe methods for evaluating the enzymatic activity and cleaning performance. The performance of polypeptide enzymes of the invention in removing stains (e.g., a protein stain such as blood/milk/ink, pigment/milk/ink or egg yolk), cleaning hard surfaces, or cleaning laundry, dishware or tableware item(s) can be readily determined using procedures well known in the art and/or by using procedures set forth in the Examples.

In some embodiments, one or more subtilisin variant described herein has one or more improved property when compared to a reference subtilisin, wherein the improved property is selected from improved protease activity, improved cleaning performance in detergent, improved thermostability in detergent, and improved aged laundry cleaning in detergent, wherein the detergent is optionally a boron-free composition. In other embodiments, one or more subtilisin variant described herein has one or more improved property when compared to a reference subtilisin, wherein the improved property is selected from improved protease activity, improved cleaning performance in detergent, improved thermostability in detergent, and improved aged laundry cleaning in detergent, wherein the detergent is optionally a boron-free composition, wherein the reference subtilisin comprises an amino acid sequence of SEQ ID NO:2, 9, or 63. In still other embodiments, one or more subtilisin variant described herein has one or more improved property when compared to a reference subtilisin, wherein the improved property is selected from improved protease activity, improved cleaning performance in detergent, improved thermostability in detergent, and improved aged laundry cleaning in detergent, wherein the detergent is optionally a boron-free composition, wherein the reference subtilisin comprises an amino acid sequence of SEQ ID NO:2 or 9. In one embodiment, one or more subtilisin variant described herein is more stable through a longer wash period as compared to a reference subtilisin. In another embodiment, one or more subtilisin variant described herein is more stable through a short, cool wash cycle or a long, hot wash-cycle as compared to a reference subtilisin. In a still yet further embodiment, the one or more improved property is (i) improved protease activity, wherein said variant has a PI>1 on N-suc-AAPF-pNA or dimethyl casein substrate; (ii) improved cleaning performance in detergent, wherein said variant has a BMI, POM, egg, and/or egg yolk cleaning PI>1, (iii) improved thermostability in detergent, wherein said variant has a stability PI>1; and/or (iv) improved aged laundry cleaning in detergent, wherein said variant has an aged laundry cleaning PI>1; wherein the detergent is optionally a boron-free composition. In yet a further embodiment, the one or more improved property is (i) improved protease activity, wherein said variant has a PI>1 on N-suc-AAPF-pNA or dimethyl casin substrate; (ii) improved cleaning performance in detergent, wherein said variant has a BMI, POM, egg, and/or egg yolk cleaning PI>1; (iii) improved thermostability in detergent, wherein said variant has a stability PI>1 or % remaining activity ≥5%, 10% 20%, 30%, 40%, 50%, 60%, 70%, 80%, 90%, 91%, 92%, 93%, 94%, 95%, 96%, 97%, 98%, 99%, 100% or more after 15-20 minutes at a stress temperature of 60° C., 61° C., 62° C., 63C, 64° C., 65° C., 66° C., 67° C., 68° C., 69° C. or more; and/or (iv) improved aged laundry cleaning in detergent, wherein said variant has (a) an aged laundry cleaning PI>1, (b) remaining cleaning activity >10%, 20% 30%, 40%, 50%, 60%, 70%, 80%, 90%, 91%, 92%, 93%, 94%, 95%, 96%, 97%, 98%, 99%, 100% or more after 24 hours at 55C, and/or (c) remaining cleaning activity >10%, 20%, 30%, 40%, 50%, 60%, 70%, 80%, 90%, 91%, 92%, 93%, 94%, 95%, 96%, 97%, 98%, 99%, 100% or more after 3 days or 3 weeks at 37° C.; wherein the detergent is optionally a boron-free composition. In an even further embodiment, one or more subtilisin variant described herein has improved protease activity, wherein said variant has a PI>1 on N-suc-AAPF-pNA or dimethyl casein substrate. In a still even further embodiment, one or more subtilisin variant described herein has improved cleaning performance in detergent, wherein said variant has a BMI, POM, and/or egg yolk cleaning PI>1, wherein the detergent is optionally a boron-free composition. In another embodiment, one or more subtilisin variant described herein has improved thermostability in detergent, wherein said variant has a stability PI>1, wherein the detergent is optionally a boron-free composition. In still another embodiment, one or more subtilisin variant described herein has improved thermostability in detergent, wherein said variant has a stability PI>1 or % remaining activity >5%, 10%20%, 30%, 40%, 50%, 60%, 70%, 80%, 90%, 91%, 92%, 93%. 94%, 95%, 6%, 97%, 98%, 99%, 100% or more after 15-20 minutes at a stress temperature of 60° C., 61° C., 62° C., 63° C., 64° C., 65° C., 66° C., 67° C., 68° C., 69° C. or more, wherein the detergent is optionally a boron-free composition. In another embodiment, one or more subtilisin variant described herein has improved aged laundry cleaning in detergent, wherein said variant has (a) an aged laundry cleaning PI>1, (b) remaining cleaning activity ≥10%, 20% 30%, 40%, 50%, 60%, 70%, 80%, 90%, 91%, 92%, 93%, 94%, 95%, 96%, 97%, 98%, 99%, 100% or more after 24 hours at 55° C., and/or (c) remaining cleaning activity >10%, 20%, 30%, 40%, 50%, 60%, 70%, 80%, 90%, 91%, 92%, 93%, 94%, 95%, 96%, 97%, 98%, 99%, 100% or more after 3 days or 3 weeks at 37C, wherein the detergent is optionally a boron-free composition. In another embodiment, one or more subtilisin variant described herein has improved aged laundry cleaning in detergent, wherein said variant has an aged laundry cleaning PI>1, wherein the detergent is optionally a boron-free composition. In another embodiment, one or more subtilisin variant described herein has improved protease activity, wherein said variant has a PI>1 on N-suc-AAPF-pNA or dimethyl casein substrate and said PI is measured in accordance with the protease activity assay of Example 1. In a further embodiment, one or more subtilisin variant described herein has improved cleaning performance in detergent, wherein said variant has a BMI, POM, egg, and/or egg yolk cleaning PI>1 and said PI is measured in accordance with the cleaning performance in laundry (HDL and HDD) and ADW detergents assay of Example 1. In an even further embodiment, one or more subtilisin variant described herein has improved thermostability in detergent, wherein said variant has a stability PI>1 and said P1 is measured in accordance with the general sample set-up for stability assay of Example 1. In yet an even further embodiment, one or more subtilisin variant described herein has improved thermostability in detergent, wherein said variant has a % remaining activity ≥5%, 10% 20%, 30%, 40%, 50%, 60%, 70%, 80%, 90%, 91%, 92%, 93%, 94%, 95%, 96%, 97%, 98%, 99%, 100% or more after 15-20 minutes at a stress temperature of 60° C., 61° C., 62° C., 63° C., 64° C., 65° C., 66° C., 67° C., 68° C., 69° C. or more and said remaining activity is measured in accordance with the general sample set-up for stability assay of Example 1. In a still further embodiment, one or more subtilisin variant described herein has improved aged laundry cleaning in detergent, wherein said variant has an aged laundry cleaning PI>1 and said PI is measured in accordance with the aged laundry cleaning assay of Example 1. In an even still further embodiment, one or more subtilisin variant described herein has improved aged laundry cleaning in detergent, wherein said variant has remaining cleaning activity >10%, 20% 30%, 40%, 50%, 60%, 70%, 80%, 90%, 91%, 92%, 93%, 94%, 95%, 96%, 97%, 98%, 99%, 100% or more after 24 hours at 55° C., and/or remaining cleaning activity >10%, 20%, 30%, 40%, 50%, 60%, 70%, 80%, 90%, 91%, 92%, 93%, 94%, 95%, 96%, 97%, 98%, 99%, 100% or more after 3 days or 3 weeks at 37° C.; and said remaining cleaning activity is measured in accordance with the aged laundry cleaning assay of Example 1.

In some embodiments, the one or more subtilisin variant described herein demonstrates cleaning performance in a cleaning composition. Cleaning compositions often include ingredients harmful to the stability and performance of enzymes, making cleaning compositions a harsh environment for enzymes, e.g. serine proteases, to retain function.

Thus, it is not trivial for an enzyme to be put in a cleaning composition and expect enzymatic function (e.g. serine protease activity, such as demonstrated by cleaning performance). In some embodiments, the one or more subtilisin variant described herein demonstrates cleaning performance in automatic dishwashing (ADW) detergent compositions. In some embodiments, the cleaning performance in ADW detergent compositions includes cleaning of egg yolk stains. In some embodiments, the one or more subtilisin variant described herein demonstrates cleaning performance in laundry detergent compositions. In some embodiments, the cleaning performance in laundry detergent compositions includes cleaning of blood/milk/ink, egg, egg yolk, and/or POM stains. In each of the cleaning compositions, one or more subtilisin variant described herein demonstrates cleaning performance with or without a bleach component. In an even still further embodiment, one or more ADW or laundry detergent composition described herein comprises one or more subtilisin variant described herein, wherein said variant is stable in the presence of one or more adjunct material and/or one or more additional enzyme and/or further wherein said variant is stable to autoprotcolysis.

One or more subtilisin variant described herein can be subject to various changes, such as one or more amino acid insertion, deletion, and/or substitution, either conservative or non-conservative, including where such changes do not substantially alter the enzymatic activity of the variant. Similarly, a nucleic acid of the invention can also be subject to various changes, such as one or more substitution of one or more nucleotide in one or more codon such that a particular codon encodes the same or a different amino acid, resulting in either a silent variation (e.g., when the encoded amino acid is not altered by the nucleotide mutation) or non-silent variation; one or more deletion of one or more nucleic acids (or codon) in the sequence; one or more addition or insertion of one or more nucleic acids (or codon) in the sequence; and/or cleavage of, or one or more truncation, of one or more nucleic acid (or codon) in the sequence. Many such changes in the nucleic acid sequence may not substantially alter the enzymatic activity of the resulting encoded polypeptide enzyme compared to the polypeptide enzyme encoded by the original nucleic acid sequence. A nucleic acid sequence described herein can also be modified to include one or more codon that provides for optimum expression in an expression system (e.g., bacterial expression system), while, if desired, said one or more codon still encodes the same amino acid(s).

Described herein is one or more isolated, non-naturally occurring, or recombinant polynucleotide comprising a nucleic acid sequence that encodes one or more subtilisin variant described herein, or recombinant polypeptide or active fragment thereof. One or more nucleic acid sequence described herein is useful in recombinant production (e.g., expression) of one or more subtilisin variant described herein, typically through expression of a plasmid expression vector comprising a sequence encoding the one or more subtilisin variant described herein or fragment thereof. One embodiment provides nucleic acids encoding one or more subtilisin variant described herein, wherein the variant is a mature form having proteolytic activity. In some embodiments, one or more subtilisin variant described herein is expressed recombinantly with a homologous pro-peptide sequence. In other embodiments, one or more subtilisin variant described herein is expressed recombinantly with a heterologous pro-peptide sequence (e.g., GG36 pro-peptide sequence).

One or more nucleic acid sequence described herein can be generated by using any suitable synthesis, manipulation, and/or isolation techniques, or combinations thereof. For example, one or more polynucleotide described herein may be produced using standard nucleic acid synthesis techniques, such as solid-phase synthesis techniques that are well-known to those skilled in the art. In such techniques, fragments of up to 50 or more nucleotide bases are typically synthesized, then joined (e.g., by enzymatic or chemical ligation methods) to form essentially any desired continuous nucleic acid sequence. The synthesis of the one or more polynucleotide described herein can be also facilitated by any suitable method known in the art, including but not limited to chemical synthesis using the classical phosphoramidite method (See e.g., Beaucage et al. Tetrahedron Letters 22:1859-69 (1981)), or the method described in Matthes et al., EMBO J. 3:801-805 (1984) as is typically practiced in automated synthetic methods. One or more polynucleotide described herein can also be produced by using an automatic DNA synthesizer. Customized nucleic acids can be ordered from a variety of commercial sources (e.g., Midland Certified Reagent Company, Great American Gene Company, Operon Technologies Inc., and DNA 2.0). Other techniques for synthesizing nucleic acids and related principles are described by, for example, Itakura et al., Ann. Rev. Biochem. 53:323 (1984) and Itakura et al., Science 198:1056 (1984).

Recombinant DNA techniques useful in modification of nucleic acids are well known in the art, such as, for example, restriction endonuclease digestion, ligation, reverse transcription and cDNA production, and polymerase chain reaction (e.g., PCR). One or more polynucleotide described herein may also be obtained by screening cDNA libraries using one or more oligonucleotide probes that can hybridize to or PCR-amplify polynucleotides which encode one or more AprL-clade variant described herein, or recombinant polypeptide or active fragment thereof. Procedures for screening and isolating cDNA clones and PCR amplification procedures are well known to those of skill in the art and described in standard references known to those skilled in the art. One or more polynucleotide described herein can be obtained by altering a naturally occurring polynucleotide backbone (e.g., that encodes one or more subtilisin variant described herein or reference subtilisin) by, for example, a known mutagenesis procedure (e.g., site-directed mutagenesis, site saturation mutagenesis, and in vitro recombination). A variety of methods are known in the art that are suitable for generating modified polynucleotides described herein that encode one or more subtilisin variant described herein, including, but not limited to, for example, site-saturation mutagenesis, scanning mutagenesis, insertional mutagenesis, deletion mutagenesis, random mutagenesis, site-directed mutagenesis, and directed-evolution, as well as various other recombinatorial approaches.

A further embodiment is directed to one or more vector comprising one or more subtilisin variant described herein (e.g., a polynucleotide encoding one or more subtilisin variant described herein); expression vectors or expression cassettes comprising one or more nucleic acid or polynucleotide sequence described herein; isolated, substantially pure, or recombinant DNA constructs comprising one or more nucleic acid or polynucleotide sequence described herein; isolated or recombinant cells comprising one or more polynucleotide sequence described herein; and compositions comprising one or more such vector, nucleic acid, expression vector, expression cassette, DNA construct, cell, cell culture, or any combination or mixtures thereof.

Some embodiments are directed to one or more recombinant cell comprising one or more vector (e.g., expression vector or DNA construct) described herein which comprises one or more nucleic acid or polynucleotide sequence described herein. Some such recombinant cells are transformed or transfected with such at least one vector, although other methods are available and known in the art. Such cells are typically referred to as host cells. Some such cells comprise bacterial cells, including, but not limited to *Bacillus* sp, cells, such as *B. subtilis* cells. Other embodiments are directed to recombinant cells (e.g., recombinant host cells) comprising one or more subtilisin described herein.

In some embodiments, one or more vector described herein is an expression vector or expression cassette comprising one or more polynucleotide sequence described herein operably linked to one or more additional nucleic acid segments required for efficient gene expression (e.g., a promoter operably linked to one or more polynucleotide sequence described herein). A vector may include a transcription terminator and/or a selection gene (e.g., an antibiotic resistant gene) that enables continuous cultural maintenance of plasmid-infected host cells by growth in antimicrobial-containing media.

An expression vector may be derived from plasmid or viral DNA, or in alternative embodiments, contains elements of both. Exemplary vectors include, but are not limited to pC194, pJH101, pE194, pHP13 (See, Harwood and Cutting [eds.]. Chapter 3, Molecular Biological Methods for *Bacillus*, John Wiley & Sons (1990); suitable replicating plasmids for *B. subtilis* include those listed on p. 92). (See also, Perego, "Integrational Vectors for Genetic Manipulations in *Bacillus subtilis*"; Sonenshein et al., [eds.]; "*Bacillus subtilis* and Other Gram-Positive Bacteria: Biochemistry, Physiology and Molecular Genetics" American Society for Microbiology, Washington, D.C. (1993), pp. 615-624); and p2JM103BB1).

For expression and production of a protein of interest (e.g., one or more subtilisin variant described herein) in a cell, one or more expression vector comprising one or more copy of a polynucleotide encoding one or more subtilisin variant described herein, and in some instances comprising multiple copies, is transformed into the cell under conditions suitable for expression of the variant. In some embodiments, a polynucleotide sequence encoding one or more subtilisin variant described herein (as well as other sequences included in the vector) is integrated into the genome of the host cell, while in other embodiments, a plasmid vector comprising a polynucleotide sequence encoding one or more subtilisin variant described herein remains as autonomous extra-chromosomal element within the cell. Some embodiments provide both extrachromosomal nucleic acid elements as well as incoming nucleotide sequences that are integrated into the host cell genome. The vectors described herein are useful for production of the one or more subtilisin variant described herein. In some embodiments, a polynucleotide construct encoding one or more subtilisin variant described herein is present on an integrating vector that enables the integration and optionally the amplification of the polynucleotide encoding the variant into the host chromosome. Examples of sites for integration are well known to those skilled in the art. In some embodiments, transcription of a polynucleotide encoding one or more subtilisin variant described herein is effectuated by a promoter that is the wild-type promoter for the parent subtilisin. In some other embodiments, the promoter is heterologous to the one or more subtilisin variant described herein, but is functional in the host cell. Exemplary promoters for use in bacterial host cells include, but are not limited to the amyE, amyQ, amyL, pstS, sacB, pSPAC, pAprE, pVeg, pHpaII promoters: the promoter of the *B. stearothermophilus* maltogenic amylase gene; the *B. amyloliquefaciens* (BAN) amylase gene, the *B. subtilis* alkaline protease gene; the *B. clausii* alkaline protease gene; the *B. pumilis* xylosidase gene: the *B. thuringiensis* cryIIIA; and the *B. licheniformis* alpha-amylase gene. Additional promoters include, but are not limited to the A4 promoter, as well as phage Lambda PR or PL promoters and the *E. coli* lac, tip or tac promoters.

One or more subtilisin variant described herein can be produced in host cells of any suitable microorganism, including bacteria and fungi. In some embodiments, one or more subtilisin variant described herein can be produced in Gram-positive bacteria. In some embodiments, the host cells are *Bacillus* spp., *Streptomyces* spp., *Escherichia* spp., *Aspergillus* spp., *Trichoderma* spp., *Pseudomonas* spp., *Corynebacterium* spp., *Saccharomyces* spp., or *Pichia* spp. In some embodiments, one or more subtilisin variant described herein is produced by *Bacillus* sp. host cells. Examples of *Bacillus* sp. host cells that find use in the production of the one or more subtilisin variant described herein include, but are not limited to *B. licheniformis. B. lentus, B. subtilis, B. amyloliquefaciens, B. lentus, B. brevis, B. stearothermophilus, B. alkalophilus. B. coagulans, B. circulans, B. pumilis, B. thuringiensis. B. clausii.* and *B. megaterium*, as well as other organisms within the genus *Bacillus*. In some embodiments, *B. subtilis* host cells are used to produce the variants described herein. U.S. Pat. Nos. 5,264,366 and 4,760,025 (RE 34,606) describe various *Bacillus* host strains that can be used to produce one or more subtilisin variant described herein, although other suitable strains can be used.

Several bacterial strains that can be used to produce one or more subtilisin variant described herein include non-recombinant (i.e., wild-type) *Bacillus* sp. strains, as well as variants of naturally-occurring strains and/or recombinant strains. In some embodiments, the host strain is a recombinant strain, wherein a polynucleotide encoding one or more subtilisin variant described herein has been introduced into the host. In some embodiments, the host strain is a *B. subtilis* host strain and particularly a recombinant *B. subtilis* host strain. Numerous *B. subtilis* strains are known, including, but not limited to for example, 1A6 (ATCC 39085), 168 (A01), SB19, W23, Ts85, B637, PB1753 through PB1758, PB3360. JH642, 1A243 (ATCC 39,087), ATCC 21332, ATCC 6051. MI113, DE100 (ATCC 39,094), GX4931, PBT 110, and PEP 211 strain (See e.g., Hoch et al., Genetics 73:215-228 (1973); See also, U.S. Pat. Nos. 4,450,235; 4,302,544; and EP 0134048). The use of *B. subtilis* as an expression host cell is well known in the art (See e.g., Palva et al., Gene 19:81-87 (1982); Fahnestock and Fischer, J. Bacteriol., 165:796-804 (1986); and Wang et al., Gene 69:39-47 (1988)).

In some embodiments, the *Bacillus* host cell is a *Bacillus* sp. that includes a mutation or deletion in at least one of the following genes: degU, degS, degR and degQ. In some embodiments, the mutation is in a degU gene, and in some embodiments the mutation is degU(Hy)32 (See e.g., Msadek et al., J. Bacteriol. 172:824-834 (1990); and Olmos et al., Mol. Gen. Genet. 253:562-567 (1997)). In some embodiments, the *Bacillus* host comprises a mutation or deletion in scoC4 (See e.g., Caldwell et al., J. Bacteriol. 183:7329-7340 (2001)); spoIIE (See e.g., Arigoni et al., Mol. Microbiol. 31:1407-1415 (1999)); and/or oppA or other genes of the opp operon (See e.g., Perego et al., Mol. Microbiol. 5:173-185 (1991)). Indeed, it is contemplated that any mutation in the opp operon that causes the same phenotype as a mutation in the oppA gene will find use in some embodiments of the altered *Bacillus* strain described herein. In some embodiments, these mutations occur alone, while in other embodiments, combinations of mutations are present. In some embodiments, an altered *Bacillus* host cell strain that can be used to produce one or more subtilisin variant described herein is a *Bacillus* host strain that already includes a mutation in one or more of the above-mentioned genes. In addition. *Bacillus* sp. host cells that comprise mutation(s) and/or deletion(s) of endogenous protease genes find use. In some embodiments. the *Bacillus* host cell comprises a deletion of the aprE and the nprE genes. In other embodiments, the *Bacillus* sp. host cell comprises a deletion of 5 protease genes, while in other embodiments the *Bacillus* sp. host cell comprises a deletion of 9 protease genes (See e.g., US 2005/0202535).

Host cells are transformed with one or more nucleic acid sequence encoding one or more subtilisin variant described herein using any suitable method known in the art. Methods for introducing a nucleic acid (e.g., DNA) into *Bacillus* cells or *E. coli* cells utilizing plasmid DNA constructs or vectors and transforming such plasmid DNA constructs or vectors into such cells are well known. In some embodiments, the plasmids are subsequently isolated from *E. coli* cells and transformed into *Bacillus* cells. However, it is not essential to use intervening microorganisms such as *E. coli*, and in some embodiments, a DNA construct or vector is directly introduced into a *Bacillus* host.

Exemplary methods for introducing one or more nucleic acid sequence described herein into *Bacillus* cells are described in, for example, Ferrari et al., "Genetics," in Harwood et al. [eds.], *Bacillus*. Plenum Publishing Corp. (1989). pp. 57-72; Saunders et al., J. Bacteriol. 157:718-726 (1984); Hoch et al., J. Bacteriol. 93:1925-1937 (1967); Mann et al., Current Microbiol. 13:131-135 (1986); Holubova, Folia Microbiol. 30:97 (1985); Chang et al., Mol. Gen. Genet. 168:11-115 (1979); Vorobjeva et al., FEMS Microbiol. Lett. 7:261-263 (1980); Smith et al., Appl. Env. Microbiol. 51:634 (1986); Fisher et al., Arch. Microbiol. 139:213-217 (1981); and McDonald, J. Gen. Microbiol. 130:203 (1984)). Indeed, such methods as transformation, including protoplast transformation and transfection, transduction, and protoplast fusion are well known and suited for use herein. Methods known in the art to transform *Bacillus* cells include such methods as plasmid marker rescue transformation, which involves the uptake of a donor plasmid by competent cells carrying a partially homologous resident plasmid (See, Contente et al., Plasmid 2:555-571 (1979); Haima et al., Mol. Gen. Genet. 223:185-191 (1990): Weinrauch et al., J. Bacteriol. 154:1077-1087 (1983); and Weinrauch et al., J. Bacteriol. 169:1205-1211 (1987)). In this method, the incoming donor plasmid recombines with the homologous region of the resident "helper" plasmid in a process that mimics chromosomal transformation.

In addition to commonly used methods, in some embodiments, host cells are directly transformed with a DNA construct or vector comprising a nucleic acid encoding one or more subtilisin variant described herein (i.e., an intermediate cell is not used to amplify, or otherwise process, the DNA construct or vector prior to introduction into the host cell). Introduction of a DNA construct or vector described herein into the host cell includes those physical and chemical methods known in the art to introduce a nucleic acid sequence (e.g., DNA sequence) into a host cell without insertion into the host genome. Such methods include, but are not limited to calcium chloride precipitation, electroporation, naked DNA, and liposomes. In additional embodiments, DNA constructs or vector are co-transformed with a plasmid, without being inserted into the plasmid. In further embodiments, a selective marker is deleted from the altered *Bacillus* strain by methods known in the art (See, Stahl et al., J. Bacteriol. 158:411-418 (1984); and Palmeros et al., Gene 247:255-264 (2000)).

In some embodiments, the transformed cells are cultured in conventional nutrient media. The suitable specific culture conditions, such as temperature. pH and the like are known to those skilled in the art and are well described in the scientific literature. Some embodiments provide a culture (e.g., cell culture) comprising one or more subtilisin variant or nucleic acid sequence described herein.

In some embodiments, host cells transformed with one or more polynucleotide sequence encoding one or more subtilisin variant described herein are cultured in a suitable nutrient medium under conditions permitting the expression of the variant, after which the resulting variant is recovered from the culture. In some embodiments, the variant produced by the cells is recovered from the culture medium by conventional procedures, including, but not limited to, for example, separating the host cells from the medium by centrifugation or filtration, precipitating the proteinaceous components of the supernatant or filtrate by means of a salt (e.g., ammonium sulfate), and chromatographic purification (e.g., ion exchange, gel filtration, affinity, etc.).

In some embodiments, one or more subtilisin variant produced by a recombinant host cell is secreted into the culture medium. A nucleic acid sequence that encodes a purification facilitating domain may be used to facilitate purification of the variant. A vector or DNA construct comprising a polynucleotide sequence encoding one or more subtilisin variant described herein may further comprise a nucleic acid sequence encoding a purification facilitating domain to facilitate purification of the variant (See e.g., Kroll et al., DNA Cell Biol. 12:441-53 (1993)). Such purification facilitating domains include, but are not limited to, for example, metal chelating peptides such as histidine-tryptophan modules that allow purification on immobilized metals (See, Porath, Protein Expr. Purif. 3:263-281 [1992]), protein A domains that allow purification on immobilized immunoglobulin, and the domain utilized in the FLAGS extension/affinity purification system. The inclusion of a cleavable linker sequence such as Factor XA or enterokinase (e.g., sequences available from Invitrogen, San Diego, Calif.) between the purification domain and the heterologous protein also find use to facilitate purification.

A variety of methods can be used to determine the level of production of one or more mature subtilisin variant described herein in a host cell. Such methods include, but are not limited to, for example, methods that utilize either polyclonal or monoclonal antibodies specific for the protease. Exemplary methods include, but are not limited to enzyme-linked immunosorbent assays (ELISA), radioimmunoassays (RIA), fluorescent immunoassays (FIA), and fluorescent activated cell sorting (FACS). These and other assays are well known in the art (See e.g., Maddox et al., J. Exp. Med. 158:1211 (1983)).

Some other embodiments provide methods for making or producing one or more mature subtilisin variant described herein. A mature subtilisin variant does not include a signal peptide or a propeptide sequence. Some methods comprise making or producing one or more subtilisin variant described herein in a recombinant bacterial host cell, such as for example, a *Bacillus* sp. cell (e.g., a *B. subtilis* cell). Other embodiments provide a method of producing one or more subtilisin variant described herein, wherein the method comprises cultivating a recombinant host cell comprising a recombinant expression vector comprising a nucleic acid sequence encoding one or more subtilisin variant described herein under conditions conducive to the production of the variant. Some such methods further comprise recovering the variant from the culture.

Further embodiments provide methods of producing one or more subtilisin variant described herein, wherein the methods comprise: (a) introducing a recombinant expression vector comprising a nucleic acid encoding the variant into a population of cells (e.g., bacterial cells, such as *B. subtilis* cells); and (b) culturing the cells in a culture medium under conditions conducive to produce the variant encoded by the expression vector. Some such methods further comprise: (c) isolating the variant from the cells or from the culture medium.

Unless otherwise noted, all component or composition levels provided herein are made in reference to the active level of that component or composition, and are exclusive of impurities, for example, residual solvents or by-products, which may be present in commercially available sources. Enzyme components weights are based on total active protein. All percentages and ratios are calculated by weight unless otherwise indicated. All percentages and ratios are calculated based on the total composition unless otherwise indicated. Compositions described herein include cleaning compositions, such as detergent compositions. In the exemplified detergent compositions, the enzyme levels are expressed by pure enzyme by weight of the total composition and unless otherwise specified, the detergent ingredients are expressed by weight of the total compositions.

In one embodiment, one or more subtilisin variant described herein is useful in cleaning applications, such as, for example, but not limited to, cleaning dishware or tableware items, fabrics, medical instruments and items having hard surfaces (e.g., the hard surface of a table, table top, wall, furniture item, floor, and ceiling). In other embodiments, one or more subtilisin variant described herein is useful in disinfecting applications, such as, for example, but not limited to, disinfecting an automatic dishwashing or laundry machine.

Another embodiment is directed to a composition comprising one or more subtilisin variant described herein. In some embodiments, the composition is a cleaning composition. In other embodiments, the composition is a detergent composition. In yet other embodiments, the composition is selected from a laundry detergent composition, an automatic dishwashing (ADW) composition, a hand (manual) dishwashing detergent composition, a hard surface cleaning composition, an eyeglass cleaning composition, a medical instrument cleaning composition, a disinfectant (e.g., malodor or microbial) composition, and a personal care cleaning composition. In still other embodiments, the composition is a laundry detergent composition, an ADW composition, or a hand (manual) dishwashing detergent composition. Even still further embodiments are directed to fabric cleaning compositions, while other embodiments are directed to non-fabric cleaning compositions. In some embodiments, the cleaning composition is boron-free. In other embodiments, the cleaning composition is phosphate-free. In still other embodiments, the composition comprises one or more subtilisin variant described herein and one or more of an excipient, adjunct material, and/or additional enzyme.

In yet still a further embodiment, the composition described herein contains phosphate, is phosphate-free, contains boron, is boron-free, or combinations thereof. In other embodiments, the composition is a boron-free composition. In some embodiments, a boron-free composition is a composition to which a borate stabilizer has not been added. In another embodiment, a boron-free composition is a composition that contains less than 5.5% boron. In a still further embodiment, a boron-free composition is a composition that contains less than 4.5% boron. In yet still another embodiment, a boron-free composition is a composition that contains less than 3.5% boron. In yet still a further embodiment, a boron-free composition is a composition that contains less than 2.5% boron. In even further embodiments, a boron-fre composition is a composition that contains less than 1.5% boron. In another embodiment, a boron-fre composition is a composition that contains less than 1.0% boron. In still further embodiments, a boron-free composition is a composition that contains less than 0.5% boron. In still further embodiments, a boron-free composition is a composition substantially-free of boron.

In another embodiment, one or more composition described herein is in a form selected from gel, tablet, powder, granular, solid, liquid, unit dose, and combinations thereof. In yet another embodiment, one or more composition described herein is in a form selected from a low water compact formula, low water HDL or UD, or high water formula or HDL. In some embodiments, the cleaning composition describe herein is in a unit dose form. In other embodiments, the unit does form is selected from pills, tablets, capsules, gelcaps, sachets, pouches, multi-compartment pouches, and pre-measured powders or liquids. In some embodiments, the unit dose format is designed to provide controlled release of the ingredients within a multi-compartment pouch (or other unit dose format). Suitable unit dose and controlled release formats are described, for example, in EP 2100949; WO 02/102955; U.S. Pat. Nos. 4,765,916; 4,972,017; and WO 04/111178. In some embodiments, the unit dose form is a tablet or powder contained in a water-soluble film or pouch.

Exemplary laundry detergent compositions include, but are not limited to, for example, liquid and powder laundry detergent compositions. Exemplary hard surface cleaning compositions include, but not limited to, for example, compositions used to clean the hard surface of a non-dishware item, non-tableware item, table, table top, furniture item, wall, floor, and ceiling. Exemplary hard surface cleaning compositions are described, for example, in U.S. Pat. Nos. 6,610,642, 6,376,450, and 6,376,450. Exemplary personal care compositions include, but are not limited to, compositions used to clean dentures, teeth, hair, contact lenses, and skin. Exemplary components of such oral care composition include those described in, for example, U.S. Pat. No. 6,376,450.

In some embodiments, one or more subtilisin variant described herein cleans at low temperatures. In other embodiments, one or more composition described herein cleans at low temperatures. In other embodiments, one or more composition described herein comprises an effective amount of one or more subtilisin variant described herein as useful or effective for cleaning a surface in need of proteinaceous stain removal In some embodiments, adjunct materials are incorporated, for example, to assist or enhance cleaning performance; for treatment of the substrate to be cleaned; or to modify the aesthetics of the cleaning composition as is the case with perfumes, colorants, dyes or the like. One embodiment is directed to a composition comprising one or more adjunct material and one or more subtilisin variant described herein. Another embodiment is directed to a composition comprising one or more adjunct material and one or more subtilisin variant described herein, wherein the adjunct material is selected from a bleach catalyst, an additional enzyme, an enzyme stabilizer (including, for example, an enzyme stabilizing system), a chelant, an optical brightener, a soil release polymer, a dye transfer agent, a dispersants, a suds suppressor, a dye, a perfume, a colorant, a filler, a photoactivator, a fluorescer, a fabric conditioner, a hydrolyzable surfactant, a preservative, an anti-oxidant, an anti-shrinkage agent, an anti-wrinkle agent, a germicide, a fungicide, a color speckle, a silvercare agent, an anti-tarnish agent, an anti-corrosion agent, an alkalinity source, a solubilizing agent, a carrier, a processing aid, a pigment, a pH control agent, a surfactant, a builder, a chelating agent, a dye transfer inhibiting agent, a deposition aid, a dispersant, a catalytic material, a bleach activator, a bleach booster, a hydrogen peroxide, a source of hydrogen peroxide, a preformed peracid, a polymeric dispersing agent, a clay soil removal/anti-redeposition agent, a structure elasticizing agent, a fabric softener, a carrier, a hydrotrope, a processing aid, a pigment, and combinations thereof. Exemplary adjunct materials and levels of use are found in U.S. Pat. Nos. 5,576,282; 6,306,812; 6,326,348; 6,610,642; 6,605,458; 5,705,464; 5,710,115; 5,698,504; 5,695,679; 5,686,014 and 5,646,101. In embodiments in which one or more cleaning adjunct material is not compatible with one or more subtilisin variant described herein, methods are employed to keep the adjunct material and variant(s) separated (i.e., not in contact with each other) until combination of the two components is appropriate. Such separation methods include any suitable method known in the art (e.g., gelcaps, encapsulation, tablets, physical separation, etc.).

Some embodiments are directed to cleaning additive products comprising one or more subtilisin variant described herein. In some embodiments, the additive is packaged in a dosage form for addition to a cleaning process. In some embodiments, the additive is packaged in a dosage form for addition to a cleaning process where a source of peroxygen is employed and increased bleaching effectiveness is desired.

Exemplary fillers or carriers for granular compositions include, but are not limited to, for example, various salts of sulfate, carbonate and silicate; talc; and clay. Exemplary fillers or carriers for liquid compositions include, but are not limited to, for example, water or low molecular weight primary and secondary alcohols including polyols and diols (e.g., methanol, ethanol, propanol and isopropanol). In some embodiments, the compositions contain from about 5% to about 90% of such filler or carrier. Acidic fillers may be included in such compositions to reduce the pH of the resulting solution in the cleaning method or application.

In one embodiment, one or more cleaning composition described herein comprises an effective amount of one or more subtilisin variant described herein, alone or in combination with one or more additional enzyme. Typically, a cleaning composition comprises at least about 0.0001 to about 20 wt. %, from about 0.0001 to about 10 wt. %, from about 0.0001 to about 1 wt. %, from about 0.001 to about 1 wt. %, or from about 0.01 to about 0.1 wt. % of one or more protease. In another embodiment, one or more cleaning composition described herein comprises from about 0.01 to about 10 mg, about 0.01 to about 5 mg, about 0.01 to about 2 mg, about 0.01 to about 1 mg, about 0.05 to about 1 mg, about 0.5 to about 10 mg, about 0.5 to about 5 mg, about 0.5 to about 4 mg, about 0.5 to about 4 mg, about 0.5 to about 3 mg, about 0.5 to about 2 mg, about 0.5 to about 1 mg, about 0.1 to about 10 mg, about 0.1 to about 5 mg, about 0.1 to about 4 mg, about 0.1 to about 3 mg, about 0.1 to about 2 mg, about 0.1 to about 2 mg, about 0.1 to about 1 mg, or about 0.1 to about 0.5 mg of one or more protease per gram of composition.

The cleaning compositions described herein are typically formulated such that during use in aqueous cleaning operations, the wash water will have a pH of from about 4.0 to about 11.5, or even from about 5.0 to about 11.5, or even from about 5.0 to about 8.0, or even from about 7.5 to about 10.5. Liquid product formulations are typically formulated to have a pH from about 3.0 to about 9.0 or even from about 3 to about 5. Granular laundry products are typically formulated to have a pH from about 9 to about 11. In some embodiments, the cleaning compositions of the present invention can be formulated to have an alkaline pH under wash conditions, such as a pH of from about 8.0 to about 12.0, or from about 8.5 to about 11.0, or from about 9.0 to about 11.0. In some embodiments, the cleaning compositions of the present invention can be formulated to have a neutral pH under wash conditions, such as a pH of from about 5.0 to about 8.0, or from about 5.5 to about 8.0, or from about 6.0 to about 8.0, or from about 6.0 to about 7.5. In some embodiments, the neutral pH conditions can be measured when the cleaning composition is dissolved 1:100 (wt:wt) in de-ionized water at 20° C., measured using a conventional pH meter. Techniques for controlling pH at recommended usage levels include the use of buffers, alkalis, acids, etc., and are well known to those skilled in the art.

In some embodiments, one or more subtilisin variant described herein is encapsulated to protect it during storage from the other components in the composition and/or control the availability of the variant during cleaning. In some embodiments, encapsulation enhances the performance of the variant and/or additional enzyme. In some embodiments, the encapsulating material typically encapsulates at least part of the subtilisin variant described herein. Typically, the encapsulating material is water-soluble and/or water-dispersible. In some embodiments, the encapsulating material has a glass transition temperature (Tg) of 0° C. or higher. Exemplary encapsulating materials include, but are not limited to, carbohydrates, natural or synthetic gums, chitin, chitosan, cellulose and cellulose derivatives, silicates, phosphates, borates, polyvinyl alcohol, polyethylene glycol, paraffin waxes, and combinations thereof. When the encapsulating material is a carbohydrate, it is typically selected from monosaccharides, oligosaccharides, polysaccharides, and combinations thereof. In some embodiments, the encapsulating material is a starch (See e.g., EP0922499, U.S. Pat. Nos. 4,977,252, 5,354,559, and 5,935,826). In some embodiments, the encapsulating material is a microsphere made from plastic such as thermoplastics, acrylonitrile, methacrylonitrile, polyacrylonitrile, polymethacrylonitrile and mixtures thereof. Exemplary commercial microspheres include, but are not limited to EXPANCEL® (Akzo Nobel Chemicals International, B.V.); PM6545, PM6550, PM7220, PM7228, and EXTENDOSPHERES® (Sphere One Inc.); and LUXSIL®, Q-CEL®, and SPHERICEL® (Potters Industries LLC).

There are a variety of wash conditions including varying detergent formulations, wash water volumes, wash water temperatures, and lengths of wash time to which one or more subtilisin variant described herein may be exposed. A low detergent concentration system is directed to wash water containing less than about 800 ppm detergent components. A medium detergent concentration system is directed to wash containing between about 800 ppm and about 2000 ppm detergent components. A high detergent concentration system is directed to wash water containing greater than about 2000 ppm detergent components. In some embodiments, the "cold water washing" of the present invention utilizes "cold water detergent" suitable for washing at temperatures from about 10° C. to about 40° C., from about 20° C. to about 30° C., or from about 15° C. to about 25° C., as well as all other combinations within the range of about 15° C. to about 35° C. or 10° C. to about 40° C.

Different geographies have different water hardness. Hardness is a measure of the amount of calcium ($Ca^{2+}$) and magnesium ($Mg^{2+}$) in the water. Water hardness is usually described in terms of the grains per gallon (gpg) mixed $Ca^{2+}/Mg^{2+}$. Most water in the United States is hard, but the degree of hardness varies. Moderately hard (60-120 ppm) to hard (121-181 ppm) water has 60 to 181 ppm (ppm can be converted to grains per U.S. gallon by dividing ppm by 17.1) of hardness minerals.

| Water | Grains per gallon | Parts per million |
| --- | --- | --- |
| Soft | less than 1.0 | less than 17 |
| Slightly hard | 1.0 to 3.5 | 17 to 60 |
| Moderately hard | 3.5 to 7.0 | 60 to 120 |
| Hard | 7.0 to 10.5 | 120 to 180 |
| Very hard | greater than 10.5 | greater than 180 |

Other embodiments are directed to one or more cleaning composition comprising from about 0.00001% to about 10% by weight composition of one or more subtilisin variant described herein and from about 99.999% to about 90.0% by weight composition of one or more adjunct material. In another embodiment, the cleaning composition comprises from about 0.0001% to about 10%, about 0.001% to about 5%, about 0.001% to about 2%, or about 0.005% to about 0.5% by weight composition of one or more subtilisin variant and from about 99.9999% to about 90.0%, about 99.999% to about 98%, about 99.995% to about 99.5% by weight composition of one or more adjunct material.

In other embodiments, the composition described herein comprises one or more subtilisin variant described herein and one or more additional enzyme. The one or more additional enzyme is selected from acyl transferases, alpha-amylases, beta-amylases, alpha-galactosidases, arabinosidases, aryl esterases, beta-galactosidases, carrageenases, catalases, cellobiohydrolases, cellulases, chondroitinases, cutinases, DNase or nuclease, endo-beta-1, 4-glucanases, endo-beta-mannanases, esterases, exo-mannanases, galactanases, glucoamylases, hemicellulases, hyaluronidases, keratinases, laccases, lactases, ligninases, lipases, lipoxygenases, lysozymes, mannanases, metalloproteases, oxidases, pectate lyases, pectin acetyl esterases, pectinases, pentosanases, peroxidases, phenoloxidases, phosphatases, phospholipases, phytases, polygalacturonases, additional proteases, pullulanases, reductases, rhamnogalacturonases, beta-glucanases, tannases, transglutaminases, xylan acetyl-esterases, xylanases, xyloglucanases, xylosidases, and any combination or mixture thereof. Some embodiments are directed to a combination of enzymes (i.e., a "cocktail") comprising conventional enzymes like amylase, lipase, cutinase and/or cellulase in conjunction with one or more subtilisin variant described herein and/or one or more additional protease.

In another embodiment, one or more composition described herein comprises one or more subtilisin variant described herein and one or more additional protease. In one embodiment, the additional protease is a serine protease. In another embodiment, the additional protease is an alkaline microbial protease or a trypsin-like protease. Suitable additional proteases include those of animal, vegetable or microbial origin. In some embodiments, the additional protease is a microbial protease. In other embodiments, the additional protease is a chemically or genetically modified mutant. In another embodiment, the additional protease is an alkaline microbial protease or a trypsin-like protease. Exemplary alkaline proteases include subtilisins derived from, for example, *Bacillus* (e.g., subtilisin, *lentus, amyloliquefaciens, gibsonii*, subtilisin Carlsberg, subtilisin 309, subtilisin 147 and subtilisin 168). Exemplary metalloproteases include nprE, the recombinant form of neutral metalloprotease expressed in *B. subtilis* (See e.g., WO 07/044993), and PMN, the purified neutral metalloprotease from *B. amyloliquefaciens*. Exemplary additional proteases include but are not limited to those described in WO92/21760, WO95/23221, WO2008010925, WO09149200, WO09149144, WO09149145, WO 10056640, WO10056653, WO20100566356, WO2011072099, WO201113022, WO11140364, WO 2012151534, WO2015038792, WO2015/089441, WO2015089447, WO2015143360, WO2016001449, WO2016001450, WO2016061438, WO2016069544, WO2016069548, WO2016069552, WO 2016069557, WO2016069563, WO2016069569, WO2016087617, WO2016087619, WO2016145428, WO2016174234, WO2016183509, WO2016202835, WO2016205755, US20080090747, U.S. Pat. Nos. 5,801,039, 5,340,735, 5,500,364, 5,855,625, RE 34,606, U.S. Pat. Nos. 5,955,340, 5,700,676, 6,312,936, 6,482,628, 8,530,219, U.S. Provisional Appl Nos. 62/331,282, 62/351,649, 62/437,171, 62/437,174, and 62/437,509, and PCT Appl Nos. PCT/CN2017/076749 and PCT/US2017/029307, as well as, metalloproteases described in WO1999014341, WO1999033960, WO1999014342, WO1999034003, WO2007044993, WO2009058303, WO 2009058661, WO2014071410, WO2014194032, WO2014194034, WO 2014194054, and WO 2014194117. Exemplary additional proteases also include, but are not limited to trypsin (e.g., of porcine or bovine origin) and the *Fusarium* protease described in WO 89/06270. Exemplary commercial proteases include, but are not limited to MAXATASE, MAXACAL, MAXAPEM, OPTICLEAN®, OPTIMASE®, PROPERASE®, PURAFECT®, PURAFECT® OXP, PURAMAX®, EXCELLASE®, PREFERENZ™ proteases (e.g. P100, P110, P280). EFFECTENZ™ proteases (e.g. P1000, P1050, P2000), EXCELLENZ™ proteases (e.g. P1000), ULTIMASE®, and PURAFAST (Danisco US); ALCALASE®ALCALASE®ULTRA, BLAZE®, BLAZE® EVITY®, BLAZE® EVITY®16L, CORONASE®, SAVINASE®, SAVINASE®ULTRA, SAVINASE® EVITY®, SAVINASE®EVERIS®, PRIMASE. DURAZYM, POLARZYME®, OVOZYME®, KANNASE®, LIQUANASE®, EVERIS®, NEUTRASE®, PROGRESS UNO®, RELASE® and ESPERASE® (Novozymes); BLAP™ and BLAP™ variants (Henkel): LAVERGY™ PRO 104 L (BASF), and KAP® (*B. alkalophilus* subtilisin) (Kao).

Another embodiment is directed to a composition comprising one or more subtilisin variant described herein and one or more lipase. In some embodiments, the composition comprises from about 0.00001% to about 10%, about 0.0001% to about 10%, about 0.001% to about 5%, about 0.001% to about 2%, or about 0.005% to about 0.5% lipase by weight composition. An exemplary lipase can be a chemically or genetically modified mutant. Exemplary lipases include, but are not limited to, e.g., those of bacterial or fungal origin, such as, e.g., *H. lanuginosa* lipase (see. e.g., EP 258068 and EP 305216), *T. lanuginosus* lipase (see, e.g., WO 2014/059360 and WO2015/010009), *Rhizomucor miehei* lipase (see. e.g., EP 238023). *Candida* lipase, such as *C. antarctica* lipase (e.g., *C. antarctica* lipase A or B) (see. e.g., EP 214761), *Pseudomonas* lipases such as *P. alcaligenes* and *P. pseudoalcaligenes* lipase (see. e.g., EP 218272), *P. cepacia* lipase (see, e.g., EP 331376), *P. stutzeri* lipase (see. e.g., GB 1,372,034), *P. fluorescens* lipase, *Bacillus* lipase (e.g., *B. subtilis* lipase (Dartois et al., Biochem. Biophys. Acta 1131: 253-260 (1993)), *B. stearothermophilus* lipase (see, e.g., JP 64/744992), and *B. pumilus* lipase (see, e.g., WO 91/16422)). Exemplary cloned lipases include, but not limited to *Penicillium camembertii* lipase (See, Yamaguchi et al., Gene 103:61-67 (1991)), Geotricum *candidum* lipase (See, Schimada et al., J. Biochem., 106:383-388 (1989)), and various *Rhizopus* lipases, such as, *R. delemar* lipase (See, Hass et al., Gene 109:117-113 (1991)), *R. niveus* lipase (Kugimiya et al., Biosci. Biotech. Biochem. 56:716-719 (1992)) and *R. oryzae* lipase. Other lipolytic enzymes, such as cutinases, may also find use in one or more composition describe herein, including, but not limited to, e.g., cutinase derived from *Pseudomonas mendocina* (see, WO 88/09367) and/or *Fusarium solani pisi* (see, WO90/09446). Exemplary commercial lipases include, but are not limited to M1 LIPASE, LUMA FAST, and LIPOMAX (Genencor); LIPEX®, LIPOCLEAN®, LIPOLASE® and LIPOLASE® ULTRA (Novozymes); and LIPASE P (Amano Pharmaceutical Co. Ltd).

A still further embodiment is directed to a composition comprising one or more subtilisin variant described herein and one or more amylase. In one embodiment, the composition comprises from about 0.00001% to about 10%, about 0.0001% to about 10%, about 0.001% to about 5%, about 0.001% to about 2%, or about 0.005% to about 0.5% amylase by weight composition. Any amylase (e.g., alpha and/or beta) suitable for use in alkaline solutions may be useful to include in such composition. An exemplary amylase can be a chemically or genetically modified mutant. Exemplary amylases include, but are not limited to those of bacterial or fungal origin, such as, for example, amylases described in GB 1,296,839, WO91/00353, WO94/02597, WO94/183314, WO95/10603, WO95/26397, WO95/35382, WO 96/05295, WO96/23873, WO96/23874, WO96/30481, WO97/10342, WO97/41213, WO97/43424, WO 98/13461, WO98/26078, WO99/02702, WO99/09183, WO99/19467, WO99/23211, WO99/29876, WO 99/42567, WO99/43793, WO99/43794, WO99/46399, WO00/29560, WO00/60058, WO00/60059, WO 00/60060, WO01/14532, WO01/34784, WO01/64852, WO01/66712, WO01/88107, WO01/96537, WO 02/092797, WO02/10355, WO02/31124, WO2004055178, WO2004113551, WO2005001064, WO 2005003311, WO2005018336, WO2005019443, WO2005066338, WO2006002643, WO2006012899, WO2006012902, WO2006031554, WO2006063594, WO2006066594, WO2006066596, WO 2006136161, WO2008000825, WO2008088493, WO2008092919, WO2008101894, WO2008112459, WO2009061380, WO2009061381. WO2009100102, WO2009140504. WO2009149419. WO 2010059413, WO2010088447, WO2010091221. WO2010104675, WO2010115021. WO2010115028. WO2010117511, WO2011076123, WO2011076897, WO2011080352, WO2011080353, WO 2011080354, WO2011082425, WO2011082429, WO2011087836, W2011098531, WO2013063460, WO2013184577, WO2014099523, WO2014164777, and WO2015077126. Exemplary commercial amylases include, but are not limited to AMPLIFY® AMPLIFY PRIME®, BAN DURAMYL®, TERMAMYL®, TERMAMYL® ULTRA, FUNGAMYL®, STAINZYME®, STAINZYME® PLUS, STAINZYME® ULTRA, and STAINZYME® EVITY® (Novozymes): EFFECTENZ™ S 1000, POWERASE®, PREFERENZ™ S 100, PREFERENZ™ S 110, EXCELLENZ™ S 2000, RAPIDASE® and MAXAMYL® P (Danisco US).

Yet a still further embodiment is directed to a composition comprising one or more subtilisin variant described herein and one or more cellulase. In one embodiment, the composition comprises from about 0.00001% to about 10%, 0.0001% to about 10%, about 0.001% to about 5%, about 0.001% to about 2%, or about 0.005% to about 0.5% cellulase by weight of composition. Any suitable cellulase may find used in a composition described herein. An exemplary cellulase can be a chemically or genetically modified mutant. Exemplary cellulases include but are not limited, to those of bacterial or fungal origin, such as, for example, is described in WO2005054475, WO2005056787, U.S. Pat. Nos. 7,449,318, 7,833,773, 4,435,307; EP 0495257; and U.S. Provisional Appl. Nos. 62/296,678 and 62/435,340. Exemplary commercial cellulases include, but are not limited to, CELLUCLEAN®, CELLUZYME®, CAREZYME®, CAREZYME® PREMIUM, ENDOLASE®, and RENOZYME® (Novozymes); REVITALENZ®100, REVITALENZ® 200/220 and REVITALENZ®2000 (Danisco US); and KAC-500(B) (Kao Corporation). In some embodiments, cellulases are incorporated as portions or fragments of mature wild-type or variant cellulases, wherein a portion of the N-terminus is deleted (see. e.g., U.S. Pat. No. 5,874,276).

An even still further embodiment is directed to a composition comprising one or more subtilisin variant described herein and one or more mannanase. In one embodiment, the composition comprises from about 0.00001% to about 10%, about 0.0001% to about 10%, about 0.001% to about 5%, about 0.001% to about 2%, or about 0.005% to about 0.5% mannanase by weight composition. An exemplary mannanase can be a chemically or genetically modified mutant. Exemplary mannanases include, but are not limited to, those of bacterial or fungal origin, such as, for example, as is described in WO2016007929, WO2017/079756 and WO2017/079751; and U.S. Pat. Nos. 6,566,114, 6,602,842, and 6,440,991. Exemplary commercial mannanases include, but are not limited to MANNAWAY® (Novozymes); and EFFECTENZ™ M 1000, PREFERENZ® M 100, MANNASTAR®, and PURABRITE (Danisco US).

A yet even still further embodiment is directed to a composition comprising one or more subtilisin variant described herein and one or more peroxidase and/or oxidase enzyme. In one embodiment, the composition comprises from about 0.00001% to about 10%, about 0.0001% to about 10%, about 0.001% to about 5%, about 0.001% to about 2%, or about 0.005% to about 0.5% peroxidase or oxidase by weight composition. A peroxidase may be used in combination with hydrogen peroxide or a source thereof (e.g., a percarbonate, perborate or persulfate) and an oxidase may be used in combination with oxygen. Peroxidases and oxidases are used for "solution bleaching" (i.e., to prevent transfer of a textile dye from a dyed fabric to another fabric when the fabrics are washed together in a wash liquor), alone or in combination with an enhancing agent (see. e.g., WO94/12621 and WO95/01426). An exemplary peroxidase and/or oxidase can be a chemically or genetically modified mutant. Exemplary peroxidases/oxidases include, but are not limited to those of plant, bacterial, or fungal origin.

Another embodiment is directed to a composition comprising one or more subtilisin variant described herein, and one or more perhydrolase, such as, for example, is described in WO2005/056782, WO2007/106293, WO 2008/063400, WO2008/106214, and WO2008/106215.

In yet another embodiment, the one or more subtilisin variant described herein and one or more additional enzyme contained in one or more composition described herein may each independently range to about 10%, wherein the balance of the cleaning composition is one or more adjunct material.

In some embodiments, one or more composition described herein finds use as a detergent additive, wherein said additive is in a solid or liquid form. Such additive products are intended to supplement and/or boost the performance of conventional detergent compositions and can be added at any stage of the cleaning process. In some embodiments, the density of the laundry detergent composition ranges from about 400 to about 1200 g/liter, while in other embodiments it ranges from about 500 to about 950 g/liter of composition measured at 20° C.

Some embodiments are directed to a laundry detergent composition comprising one or more subtilisin variant described herein and one or more adjunct material selected from surfactants, enzyme stabilizers, builder compounds, polymeric compounds, bleaching agents, additional enzymes, suds suppressors, dispersants, lime-soap dispersants, soil suspension agents, anti-redeposition agents, corrosion inhibitors, and combinations thereof. In some embodiments, the laundry compositions also contain softening agents.

Further embodiments are directed to manual dishwashing composition comprising one or more subtilisin variant described herein and one or more adjunct material selected from surfactants, organic polymeric compounds, suds enhancing agents, group II metal ions, solvents, hydrotropes, and additional enzymes.

Other embodiments are directed to one or more composition described herein, wherein said composition is a compact granular fabric cleaning composition that finds use in laundering colored fabrics or provides softening through the wash capacity, or is a heavy duty liquid (HDL) fabric cleaning composition. Exemplary fabric cleaning compositions and/or processes for making are described in U.S. Pat. Nos. 6,610,642 and 6,376,450. Other exemplary cleaning compositions are described, for example, in U.S. Pat. Nos. 6,605,458; 6,294,514; 5,929,022; 5,879,584; 5,691,297; 5,565,145; 5,574,005; 5,569,645; 5,565,422; 5,516,448; 5,489,392; and 5,486,303; 4,968,451; 4,597,898; 4,561,998; 4,550,862; 4,537,706; 4,515,707; and 4,515,705.

In some embodiments, the cleaning compositions comprise an acidifying particle or an amino carboxylic builder. Examples of an amino carboxylic builder include aminocarboxylic acids, salts and derivatives thereof. In some embodiment, the amino carboxylic builder is an aminopolycarboxylic builder, such as glycine-N,N-diacetic acid or derivative of general formula MOOC—CHR—N(CH$_2$COOM)$_2$ where R is C$_{1-12}$alkyl and M is alkali metal. In some embodiments, the amino carboxylic builder can be methylglycine diacetic acid (MGDA), GLDA (glutamic-N,N-diacetic acid), iminodisuccinic acid (IDS), carboxymethyl inulin and salts and derivatives thereof, aspartic acid-N-monoacetic acid (ASMA), aspartic acid-N,N-diacetic acid (ASDA), aspartic acid-N-monopropionic acid (ASMP), iminodisuccinic acid (IDA), N-(2-sulfomethyl) aspartic acid (SMAS), N-(2-sulfoethyl) aspartic acid (SEAS), N-(2-sulfomethyl)glutamic acid (SMGL), N-(2-sulfoethyl) glutamic acid (SEGL), IDS (iminodiacetic acid) and salts and derivatives thereof such as N-methyliminodiacetic acid (MIDA), alpha-alanine-N,N-diacetic acid (alpha-ALDA), serine-N,N-diacetic acid (SEDA), isoserine-N,N-diacetic acid (ISDA), phenylalanine-N,N-diacetic acid (PHDA), anthranilic acid-N,N-diacetic acid (ANDA), sulfanilic acid-N,N-diacetic acid (SLDA), taurine-N,N-diacetic acid (TUDA) and sulfomethyl-N,N-diacetic acid (SMDA) and alkali metal salts and derivative thereof. In some embodiments, the acidifying particle has a weight geometric mean particle size of from about 400p to about 1200p and a bulk density of at least 550 g/L. In some embodiments, the acidifying particle comprises at least about 5% of the builder.

In some embodiments, the acidifying particle can comprise any acid, including organic acids and mineral acids. Organic acids can have one or two carboxyls and in some instances up to 15 carbons, especially up to 10 carbons, such as formic, acetic, propionic, capric, oxalic, succinic, adipic, maleic, fumaric, sebacic, malic, lactic, glycolic, tartaric and glyoxylic acids. In some embodiments, the acid is citric acid. Mineral acids include hydrochloric and sulphuric acid. In some instances, the acidifying particle is a highly active particle comprising a high level of amino carboxylic builder. Sulphuric acid has also been found to further contribute to the stability of the final particle.

Additional embodiments are directed to a cleaning composition comprising one or more subtilisin variant and one or more surfactant and/or surfactant system, wherein the surfactant is selected from nonionic surfactants, anionic surfactants, cationic surfactants, ampholytic surfactants, zwitterionic surfactants, semi-polar nonionic surfactants, and mixtures thereof. In some embodiments, the surfactant is present at a level of from about 0.1 to about 60%, while in alternative embodiments the level is from about 1 to about 500%, while in still further embodiments the level is from about 5 to about 40%, by weight of the cleaning composition.

In some embodiments, one or more composition described herein comprises one or more detergent builders or builder systems. In one embodiment, the composition comprises from about 1%, from about 0.1% to about 80%, from about 3% to about 60%, from about 5% to about 40%, or from about 10% to about 50% builder by weight composition. Exemplary builders include, but are not limited to alkali metal; ammonium and alkanolammonium salts of polyphosphates; alkali metal silicates; alkaline earth and alkali metal carbonates; aluminosilicates; polycarboxylate compounds; ether hydroxypolycarboxylates; copolymers of maleic anhydride with ethylene or vinyl methyl ether, 1, 3, 5-trihydroxy benzene-2, 4, 6-trisulphonic acid, and carboxymethyloxysuccinic acid; ammonium and substituted ammonium salts of polyacetic acids such as ethylenediamine tetraacetic acid and nitrilotriacetic acid; polycarboxylates such as mellitic acid, succinic acid, citric acid, oxydisuccinic acid, polymaleic acid, benzene 1,3,5-tricarboxylic acid, carboxymethyloxysuccinic acid; and soluble salts thereof. In some such compositions, the builders form water-soluble hardness ion complexes (e.g., sequestering builders), such as citrates and polyphosphates, e.g., sodium tripolyphosphate, sodium tripolyphospate hexahydrate, potassium tripolyphosphate, and mixed sodium and potassium tripolyphosphate. Exemplary builders are described in, e.g., EP 2100949. In some embodiments, the builders include phosphate builders and non-phosphate builders. In some embodiments, the builder is a phosphate builder. In some embodiments, the builder is a non-phosphate builder. In some embodiments, the builder comprises a mixture of phosphate and non-phosphate builders. Exemplary phosphate builders include, but are not limited to mono-phosphates, di-phosphates, tri-polyphosphates or oligomeric-poylphosphates, including the alkali metal salts of these compounds, including the sodium salts. In some embodiments, a builder can be sodium tripolyphosphate (STPP). Additionally, the composition can comprise carbonate and/or citrate. Other suitable non-phosphate builders include homopolymers and copolymers of polycarboxylie acids and their partially or completely neutralized salts, monomeric polycarboxylic acids and hydroxycarboxylic acids and their salts. In some embodiments, salts of the above mentioned compounds include the ammonium and/or alkali metal salts, i.e. the lithium, sodium, and potassium salts, including sodium salts. Suitable polycarboxylic acids include acyclic, alicyclic, hetero-cyclic and aromatic carboxylic acids, wherein in some embodiments, they can contain at least two carboxyl groups which are in each case separated from one another by, in some instances, no more than two carbon atoms.

In some embodiments, one or more composition described herein comprises one or more chelating agent. In one embodiment, the composition comprises from about 0.1% to about 15% or about 3% to about 10% chelating agent by weight composition. Exemplary chelating agents include, but are not limited to, e.g., copper, iron, manganese, and mixtures thereof.

In some embodiments, one or more composition described herein comprises one or more deposition aid. Exemplary deposition aids include, but are not limited to, e.g., polyethylene glycol; polypropylene glycol; polycarboxylate; soil release polymers, such as, e.g., polytelephthalic acid; clays such as, e.g., kaolinite, montmorillonite, atapulgite, illite, bentonite, and halloysite; and mixtures thereof.

In other embodiments, one or more composition described herein comprises one or more anti-redeposition agent or non-ionic surfactant (which can prevent the re-deposition of soils) (see, e.g., EP 2100949). For example, in ADW compositions, non-ionic surfactants find use for surface modification purposes, in particular for sheeting, to avoid filming and spotting and to improve shine. These non-ionic surfactants also find use in preventing the re-deposition of soils. In some embodiments, the non-ionic surfactant can be ethoxylated nonionic surfactants, epoxy-capped poly(oxyalkylated) alcohols and amine oxides surfactants.

In some embodiments, one or more composition described herein comprises one or more dye transfer inhibiting agent. Exemplary polymeric dye transfer inhibiting agents include, but are not limited to, polyvinylpyrrolidone polymers, polyamine N-oxide polymers, copolymers of N-vinylpyrrolidone and N-vinylimidazole, polyvinyloxazolidones, polyvinylimidazoles, and mixtures thereof. In one embodiment, the composition comprises from about 0.0001% to about 10%, about 0.01% to about 5%, or about 0.1% to about 3% dye transfer inhibiting agent by weight composition.

In some embodiments, one or more composition described herein comprises one or more silicate. Exemplary silicates include, but are not limited to, sodium silicates, e.g., sodium disilicate, sodium metasilicate, and crystalline phyllosilicates. In some embodiments, silicates are present at a level of from about 1% to about 20% or about 5% to about 15% by weight of the composition.

In some still additional embodiments, one or more composition described herein comprises one or more dispersant. Exemplary water-soluble organic materials include, but are not limited to, e.g., homo- or co-polymeric acids or their salts, in which the polycarboxylic acid comprises at least two carboxyl radicals separated from each other by not more than two carbon atoms.

In some further embodiments, one or more composition described herein comprises one or more enzyme stabilizer. In some embodiments, the enzyme stabilizer is water-soluble sources of calcium and/or magnesium ions. In some embodiments, the enzyme stabilizers include oligosaccharides, polysaccharides, and inorganic divalent metal salts, including alkaline earth metals, such as calcium salts. In some embodiments, the enzymes employed herein are stabilized by the presence of water-soluble sources of zinc (II), calcium (II) and/or magnesium (II) ions in the finished compositions that provide such ions to the enzymes, as well as other metal ions (e.g., barium (II), scandium (II), iron (II), manganese (II), aluminum (III), tin (II), cobalt (II), copper (II), nickel (II), and oxovanadium (IV)). Chlorides and sulfates also find use in some embodiments. Exemplary oligosaccharides and polysaccharides (e.g., dextrins) are described, for example, in WO 07/145964. In some embodiments, reversible protease inhibitors also find use, such as boron-containing compounds (e.g., borate, 4-formyl phenyl boronic acid, and phenyl-boronic acid derivatives (such for example, those described in WO96/41859) and/or a peptide aldehyde, such as, for example, is further described in WO2009/118375 and WO2013004636.

In some embodiments, one or more composition described herein comprises one or more bleach, bleach activator, and/or bleach catalyst. In some embodiments, one or more composition described herein comprises one or more inorganic and/or organic bleaching compound. Exemplary inorganic bleaches include, but are not limited to perhydrate salts, e.g., perborate, percarbonate, perphosphate, persulfate, and persilicate salts. In some embodiments, inorganic perhydrate salts are alkali metal salts. In some embodiments, inorganic perhydrate salts are included as the crystalline solid, without additional protection, although in some other embodiments, the salt is coated. Bleach activators are typically organic peracid precursors that enhance the bleaching action in the course of cleaning at temperatures of 60° C. and below. Exemplary bleach activators include compounds which, under perhydrolysis conditions, give aliphatic peroxoycarboxylic acids having from about 1 to about 10 carbon atoms or about 2 to about 4 carbon atoms, and/or optionally substituted perbenzoic acid. Exemplary bleach activators are described, for example, in EP 2100949. Exemplary bleach catalysts include, but are not limited to, manganese triazacyclononane and related complexes, as well as cobalt, copper, manganese, and iron complexes. Additional exemplary bleach catalysts are described, for example, in U.S. Pat. Nos. 4,246,612; 5,227,084; 4,810,410; WO 99/06521; and EP 2100949.

In some embodiments, one or more composition described herein comprises one or more catalytic metal complexes. In some embodiments, a metal-containing bleach catalyst finds use. In some embodiments, the metal bleach catalyst comprises a catalyst system comprising a transition metal cation of defined bleach catalytic activity (e.g., copper, iron, titanium, ruthenium, tungsten, molybdenum, or manganese cations), an auxiliary metal cation having little or no bleach catalytic activity (e.g., zinc or aluminum cations), and a sequestrate having defined stability constants for the catalytic and auxiliary metal cations, particularly ethylenediaminetetraacetic acid, ethylenediaminetetra (methylenephosphonic acid) and water-soluble salts thereof (see, e.g., U.S. Pat. No. 4,430,243). In some embodiments, one or more composition described herein is catalyzed by means of a manganese compound. Such compounds and levels of use are described, for example, in U.S. Pat. No. 5,576,282. In additional embodiments, cobalt bleach catalysts find use and are included in one or more composition described herein. Various cobalt bleach catalysts are described, for example, in U.S. Pat. Nos. 5,597,936 and 5,595,967.

In some additional embodiments, one or more composition described herein includes a transition metal complex of a macropolycyclic rigid ligand (MRL). As a practical matter, and not by way of limitation, in some embodiments, the compositions and cleaning processes described herein are adjusted to provide on the order of at least one part per hundred million, from about 0.005 ppm to about 25 ppm, about 0.05 ppm to about 10 ppm, or about 0.1 ppm to about 5 ppm of active MRL in the wash liquor. Exemplary MRLs include, but are not limited to special ultra-rigid ligands that are cross-bridged, such as, e.g., 5,12-diethyl-1,5,8,12-tetraazabicyclo (6.6.2) hexadecane. Exemplary metal MRLs are described, for example, in WO 2000/32601 and U.S. Pat. No. 6,225,464.

In another embodiment, one or more composition described herein comprises one or more metal care agent. In some embodiments, the composition comprises from about 0.1% to about 5% metal care agent by weight composition. Exemplary metal care agents include, for example, aluminum, stainless steel, and non-ferrous metals (e.g., silver and copper). Additional exemplary metal care agents are described, for example, in EP 2100949, WO 94/26860, and WO 94/26859. In some compositions, the metal care agent is a zinc salt.

In some embodiments, the cleaning composition is a high density liquid (HDL) composition comprising one or more subtilisin variant described herein. The HDL liquid laundry detergent can comprise a detersive surfactant (10-40%) comprising anionic detersive surfactant selected from a group of linear or branched or random chain, substituted or unsubstituted alkyl sulphates, alkyl sulphonates, alkyl alkoxylated sulphate, alkyl phosphates, alkyl phosphonates, alkyl carboxylates, and/or mixtures thereof; and optionally non-ionic surfactant selected from a group of linear or branched or random chain, substituted or unsubstituted alkyl alkoxylated alcohol, for example, a $C_8$-$C_{18}$alkyl ethoxylated alcohol and/or $C_6$-$C_{12}$ alkyl phenol alkoxylates, optionally wherein the weight ratio of anionic detersive surfactant (with a hydrophilic index (HIc) of from 6.0 to 9) to non-ionic detersive surfactant is greater than 1:1. Suitable detersive surfactants also include cationic detersive surfactants (selected from alkyl pyridinium compounds, alkyl quaternary ammonium compounds, alkyl quaternary phosphonium compounds, alkyl ternary sulphonium compounds, and/or mixtures thereof); zwitterionic and/or amphoteric detersive surfactants (selected from alkanolamine sulpho-betaines); ampholytic surfactants; semi-polar non-ionic surfactants; and mixtures thereof.

In another embodiment, the cleaning composition is a liquid or gel detergent, which is not unit dosed, that may be aqueous, typically containing at least 20% and up to 95% water by weight, such as up to about 70% water by weight, up to about 65% water by weight, up to about 55% water by weight, up to about 45% water by weight, or up to about 35% water by weight. Other types of liquids, including without limitation, alkanols, amines, diols, ethers and polyols may be included in an aqueous liquid or gel. An aqueous liquid or gel detergent may contain from 0-30% organic solvent. A liquid or gel detergent may be non-aqueous.

The composition can comprise optionally, a surfactancy boosting polymer consisting of amphiphilic alkoxylated grease cleaning polymers selected from a group of alkoxylated polymers having branched hydrophilic and hydrophobic properties, such as alkoxylated polyalkylenimines in the range of 0.05 wt %-10 wt % and/or random graft polymers typically comprising a hydrophilic backbone comprising monomers selected from the group consisting of: unsaturated $C_1$-$C_6$carboxylic acids, ethers, alcohols, aldehydes, ketones, esters, sugar units, alkoxy units, maleic anhydride, saturated polyalcohols such as glycerol, and mixtures thereof; and hydrophobic side chain(s) selected from the group consisting of: $C_4$-$C_{25}$alkyl group, polypropylene, polybutylene, vinyl ester of a saturated $C_2$-$C_6$mono-carboxylic acid, $C_1$-$C_6$alkyl ester of acrylic or methacrylic acid, and mixtures thereof.

The composition can comprise additional polymers such as soil release polymers including, for example, anionically end-capped polyesters, for example SRP1; polymers comprising at least one monomer unit selected from saccharide, dicarboxylic acid, polyol and combinations thereof, in random or block configuration; ethylene terephthalate-based polymers and co-polymers thereof in random or block configuration, for example, Repel-o-tex SF, SF-2 and SRP6, Texcare SRA100, SRA300, SRN100, SRN170, SRN240, SRN300 and SRN325, Marloquest SL; anti-redeposition polymers (0.1 wt % to 10 wt %, including, for example, carboxylate polymers, such as polymers comprising at least one monomer selected from acrylic acid, maleic acid (or maleic anhydride), fumaric acid, itaconic acid, aconitic acid, mesaconic acid, citraconic acid, methylenemalonic acid, and any mixture thereof; vinylpyrrolidone homopolymer; and/or polyethylene glycol with a molecular weight in the range of from 500 to 100,000 Da); cellulosic polymer (including, for example, alkyl cellulose; alkyl alkoxyalkyl cellulose; carboxyalkyl cellulose; alkyl carboxyalkyl cellulose, examples of which include carboxymethyl cellulose, methyl cellulose, methyl hydroxyethyl cellulose, methyl carboxymethyl cellulose; and mixtures thereof); and polymeric carboxylate (such as, for example, maleate/acrylate random copolymer or polyacrylate homopolymer).

The composition can further comprise saturated or unsaturated fatty acid, preferably saturated or unsaturated $C_{12}$-$C_{24}$fatty acid (0-10 wt %); deposition aids (including, for example, polysaccharides, cellulosic polymers, polydiallyl dimethyl ammonium halides (DADMAC), and co-polymers of DADMAC with vinyl pyrrolidone, acrylamides, imidazoles, imidazolinium halides, and mixtures thereof, in random or block configuration; cationic guar gum; cationic cellulose such as cationic hydoxyethyl cellulose; cationic starch; cationic polyacylamides; and mixtures thereof.

The composition can further comprise dye transfer inhibiting agents examples of which include manganese phthalocyanine, peroxidases, polyvinvlpyrrolidone polymers, polyamine N-oxide polymers, copolymers of N-vinylpyrrolidone and N-vinylimidazole, polyvinyloxazolidones and polyvinylimidazoles and/or mixtures thereof; chelating agents examples of which include ethylene-diamine-tetraacetic acid (EDTA); diethylene triamine penta methylene phosphonic acid (DTPMP); hydroxy-ethane diphosphonic acid (HEDP); ethylenediamine N,N'-disuccinic acid (EDDS); methyl glycine diacetic acid (MGDA); diethylene triamine penta acetic acid (DTPA); propylene diamine tetracetic acid (PDT A); 2-hydroxypyridine-N-oxide (HPNO); or methyl glycine diacetic acid (MGDA); glutamic acid N,N-diacetic acid (N,N-dicarboxymethyl glutamic acid tetrasodium salt (GLDA); nitrilotriacetic acid (NTA); 4,5-dihydroxy-m-benzenedisulfonic acid; citric acid and any salts thereof; N-hydroxvethvlethylenediaminetri-acetic acid (HEDTA), triethylenetctraaminchexaacetic acid (TTHA), N-hydroxyethyliminodiacetic acid (HEIDA), dihydroxyethylglycine (DHEG), ethylenediaminetetrapropionic acid (EDTP), and derivatives thereof.

The composition can further comprise silicone or fattyacid based suds suppressors; an enzyme stabilizer; hueing dyes, calcium and magnesium cations, visual signaling ingredients, anti-foam (0.001 to about 4.0 wt. %), and/or structurant/thickener (0.01-5 wt. %) selected from the group consisting of diglycerides, triglycerides, ethylene glycol distearate, microcrystalline cellulose, cellulose based materials, microfiber cellulose, biopolymers, xanthan gum, gellan gum, and mixtures thereof.

In some embodiments, the cleaning composition is a high density powder (HDD) composition comprising one or more subtilisin variant described herein. The HDD powder laundry detergent can comprise a detersive surfactant including anionic detersive surfactants (selected from linear or branched or random chain, substituted or unsubstituted alkyl sulphates, alkyl sulphonates, alkyl alkoxylated sulphate, alkyl phosphates, alkyl phosphonates, alkyl carboxylates and/or mixtures thereof), non-ionic detersive surfactant (selected from I linear or branched or random chain, substituted or unsubstituted $C_8$-$C_{18}$ alkyl ethoxylates, and/or $C_6$-$C_{12}$ alkyl phenol alkoxylates), cationic detersive surfactants (selected from alkyl pyridinium compounds, alkyl quaternary ammonium compounds, alkyl quaternary phosphonium compounds, alkyl ternary sulphonium compounds, and mixtures thereof); zwitterionic and/or amphoteric detersive surfactants (selected from alkanolamine sulpho-betaines); ampholytic surfactants; semi-polar non-ionic surfactants and mixtures thereof; builders (phosphate free builders, e.g., zeolite builders examples of which include zeolite A, zeolite X, zeolite P and zeolite MAP in the range of 0 to less than 10 wt. %); phosphate builders, e.g., sodium tri-polyphosphate in the range of 0 to less than 10 wt %; citric acid, citrate salts and nitrilotriacetic acid or salt thereof in the range of less than 15 wt. %; silicate salt (sodium or potassium silicate or sodium meta-silicate in the range of 0 to less than 10 wt. % or layered silicate (SKS-6)); carbonate salt (sodium carbonate and/or sodium bicarbonate in the range of 0 to less than 10 wt. %); and bleaching agents (photobleaches, e.g., sulfonated zinc phthalocyanines, sulfonated aluminum phthalocyanines, xanthencs dyes, and mixtures thereof); hydrophobic or hydrophilic bleach activators (e.g., dodecanoyl oxybenzene sulfonate, decanoyl oxybenzene sulfonate, decanoyl oxybenzoic acid or salts thereof, 3,5,5-trimethy hexanoyl oxybenzene sulfonate, tetraacetyl ethylene diamine-TAED, and nonanoyloxybenzene sulfonate-NOBS, nitrile quats, and mixtures thereof); hydrogen peroxide; sources of hydrogen peroxide (inorganic perhydrate salts, e.g., mono or tetra hydrate sodium salt of perborate, percarbonate, persulfate, perphosphate, or persilicate); preformed hydrophilic and/or hydrophobic peracids (selected from percarboxylic acids and salts, percarbonic acids and salts, perimidic acids and salts, peroxymonosulfuric acids and salts, and mixtures thereof), and/or bleach catalyst (e.g., imine bleach boosters, such as iminium cations and polyions; iminium zwitterions; modified amines; modified amine oxides; N-sulphonyl imines; N-phosphonyl imines; N-acyl imines; thiadiazole dioxides; perfluoroimines; cyclic sugar ketones and mixtures thereof), metal-containing bleach catalyst (e.g., copper, iron, titanium, ruthenium, tungsten, molybdenum, or manganese cations along with an auxiliary metal cations such as zinc or aluminum and a sequestrate such as ethylenediaminetetraacetic acid, ethylenediaminetetra(methylenephosphonic acid) and water-soluble salts thereof).

The composition can further comprise additional detergent ingredients including perfume microcapsules, starch encapsulated perfume accord, an enzyme stabilizer, hueing agents, additional polymers including fabric integrity and cationic polymers, dye lock ingredients, fabric-softening agents, brighteners (for example C.I. Fluorescent brighteners), flocculating agents, chelating agents, alkoxylated polyamines, fabric deposition aids, and/or cyclodextrin.

In some embodiments, the cleaning composition is an ADW detergent composition comprising one or more subtilisin variant described herein. The ADW detergent composition can comprise two or more non-ionic surfactants selected from ethoxylated non-ionic surfactants, alcohol alkoxylated surfactants, epoxy-capped poly(oxyalkylated) alcohols, and amine oxide surfactants present in amounts from 0-10% by wt., builders in the range of 5-60% by wt. comprising either phosphate (mono-phosphates, di-phosphates, tri-polyphosphates or oligomeric-poylphosphates), sodium tripolyphosphate-STPP or phosphate-free builders (amino acid based compounds, e.g., MGDA (methyl-glycine-diacetic acid) and salts and derivatives thereof, GLDA (glutamic-N,N-diacetic acid) and salts and derivatives thereof, IDS (iminodisuccinic acid) and salts and derivatives thereof, carboxy methyl inulin and salts and derivatives thereof and mixtures thereof, nitrilotriacetic acid (NTA), diethylene triamine penta acetic acid (DTPA), and B-alaninediacetic acid (B-ADA) and their salts), homopolymers and copolymers of polycarboxylic acids and their partially or completely neutralized salts, monomeric polycarboxylic acids and hydroxycarboxylic acids and their salts in the range of 0.5-50% by wt; sulfonated/carboxylated polymers (provide dimensional stability to the product) in the range of about 0.1 to about 50% by wt; drying aids in the range of about 0.1 to about 10% by wt (selected from polyesters, especially anionic polyesters optionally together with further monomers with 3-6 functionalities which are conducive to polycondensation, specifically acid, alcohol or ester functionalities, polycarbonate-, polyurethane- and/or polyureapolyorganosiloxane compounds or precursor compounds thereof of the reactive cyclic carbonate and urea type); silicates in the range from about 1 to about 20% by wt (sodium or potassium silicates, e.g., sodium disilicate, sodium meta-silicate and crystalline phyllosilicates); bleachinorganic (e.g., perhydrate salts such as perborate, percarbonate, perphosphate, persulfate and persilicate salts) and organic (e.g., organic peroxyacids including diacyl and tetraacylperoxides, especially diperoxydodecanedioc acid, diperoxytetradecanedioc acid, and diperoxyhexadecanedioc acid); bleach activator-organic peracid precursors in the range from about 0.1 to about 10% by wt.; bleach catalysts (selected from manganese triazacyclononane and related complexes, Co, Cu, Mn and Fe bispyridylamine and related complexes, and pentamine acetate cobalt(III) and related complexes); metal care agents in the range from about 0.1-5% by wt (selected from benzatriazoles, metal salts and complexes, and silicates); enzymes in the range from about 0.01-5.0 mg of active enzyme per gram of ADW detergent composition (acyl transferases, alpha-amylases, beta-amylases, alpha-galactosidases, arabinosidases, aryl esterases, beta-galactosidases, carrageenases, catalases, cellobiohydrolases, cellulases, chondroitinases, cutinases, endo-beta-1, 4-glucanases, endo-beta-mannanases, esterases, exo-mannanases, galactanases, glucoamylases, hemicellulases, hyaluronidases, keratinases, laccases, lactases, ligninases, lipases, lipoxygenases, mannanases, oxidases, pectate lyases, pectin acetyl esterases, pectinases, pentosanases, peroxidases, phenoloxidases, phosphatases, phospholipases, phytases, polygalacturonases, proteases, pullulanases, reductases, rhamnogalacturonases, beta-glucanases, tannases, transglutaminases, xylan acetyl-esterases, xylanases, xyloglucanases, xylosidases, and mixtures thereof); and enzyme stabilizer components (selected from oligosaccharides, polysaccharides and inorganic divalent metal salts).

More embodiments are directed to compositions and methods of treating fabrics (e.g., to desize a textile) using one or more subtilisin variant described herein. Fabric-treating methods are well known in the art (see, e.g., U.S. Pat. No. 6,077,316). For example, the feel and appearance of a fabric can be improved by a method comprising contacting the fabric with a variant described herein in a solution. The fabric can be treated with the solution under pressure.

One or more subtilisin variant described herein can be applied during or after weaving a textile, during the desizing stage, or one or more additional fabric processing steps. During the weaving of textiles, the threads are exposed to considerable mechanical strain. Prior to weaving on mechanical looms, warp yarns are often coated with sizing starch or starch derivatives to increase their tensile strength and to prevent breaking. One or more subtilisin variant described herein can be applied during or after weaving to remove the sizing starch or starch derivatives. After weaving, the variant can be used to remove the size coating before further processing the fabric to ensure a homogeneous and wash-proof result. One or more subtilisin variant described herein can be used alone or with other desizing chemical reagents and/or desizing enzymes to desize fabrics, including cotton-containing fabrics, as detergent additives, e.g., in aqueous compositions. An amylase also can be used in compositions and methods for producing a stonewashed look on indigo-dyed denim fabric and garments. For the manufacture of clothes, the fabric can be cut and sewn into clothes or garments, which are afterwards finished. In particular, for the manufacture of denim jeans, different enzymatic finishing methods have been developed. The finishing of denim garment normally is initiated with an enzymatic desizing step, during which garments are subjected to the action of proteolytic enzymes to provide softness to the fabric and make the cotton more accessible to the subsequent enzymatic finishing steps. One or more subtilisin variant described herein can be used in methods of finishing denim garments (e.g., a "bio-stoning process"), enzymatic desizing and providing softness to fabrics, and/or finishing process.

In further embodiments, one or more subtilisin variant described herein can be used in industrial and institutional cleaning applications, such as, for example, in an industrial or institutional warewashing system, machine, or process; an industrial or institutional on premises laundry system, machine or process; and an industrial or institutional laundry system, machine or process.

One or more subtilisin variant described herein can be used to remove proteins from animals and their subsequent degradation or disposal, such as, e.g., feathers, skin, hair, and hide. In some instances, immersion of the animal carcass in a solution comprising one or more subtilisin variant described herein can act to protect the skin from damage in comparison to the traditional immersion in scalding water or the defeathering process. In one embodiment, feathers can be sprayed with one or more subtilisin variant described herein under conditions suitable for digesting or initiating degradation of the plumage. In some embodiments, the variant can be used in combination with an oxidizing agent.

In some embodiments, the removal of the oil or fat associated with raw feathers can be assisted by one or more subtilisin variant described herein. In some embodiments, one or more subtilisin variant described herein is used in compositions for cleaning the feathers as well as to sanitize and partially dehydrate the fibers. In yet other embodiments, one or more subtilisin variant described herein finds use in recovering protein from plumage. In some other embodiments, one or more subtilisin variant described herein is applied in a wash solution in combination with 95% ethanol or other polar organic solvent with or without a surfactant at about 0.5% (v/v). In other embodiments, one or more subtilisin variant described herein may be used alone or in combination in suitable feather processing and proteolytic methods, such as those disclosed in PCT/EP2013/065362, PCT/EP2013/065363, and PCT/EP2013/065364. In some embodiments, the recovered protein can be subsequently used in animal or fish feed.

In still another embodiment, one or more animal feed composition, animal feed additive and/or pet food comprises one or more subtilisin variant described herein. Other embodiments are directed to methods for preparing such an animal feed composition, animal feed additive composition and/or pet food comprising mixing one or more subtilisin variant described herein with one or more animal feed ingredients and/or animal feed additive ingredients and/or pet food ingredients.

The term "animal" includes all non-ruminant and ruminant animals. In a particular embodiment, the animal is a non-ruminant animal, such as a horse and a mono-gastric animal. Examples of mono-gastric animals include, but are not limited to, pigs and swine, such as piglets, growing pigs, sows; poultry such as turkeys, ducks, chicken, broiler chicks, layers; fish such as salmon, trout, tilapia, catfish and carps; and crustaceans such as shrimps and prawns. In a further embodiment, the animal is a ruminant animal including, but not limited to, cattle, young calves, goats, sheep, giraffes, bison, moose, elk, yaks, water buffalo, deer, camels, alpacas, llamas, antelope, pronghorn and nilgai.

In the present context, it is intended that the term "pet food" is understood to mean a food for a household animal such as, but not limited to, dogs, cats, gerbils, hamsters, chinchillas, fancy rats, guinea pigs; avian pets, such as *canaries*, parakeets, and parrots; reptile pets, such as turtles, lizards and snakes; and aquatic pets, such as tropical fish and frogs.

The terms "animal feed composition," 'feedstuff' and "fodder" are used interchangeably and can comprise one or more feed materials selected from a) cereals, such as small grains (e.g., wheat, barley, rye, oats and combinations thereof) and/or large grains such as maize or sorghum; b) by products from cereals, such as corn gluten meal, Distillers Dried Grain Solubles (DDGS) (particularly corn based Distillers Dried Grain Solubles (cDDGS), wheat bran, wheat middlings, wheat shorts, rice bran, rice hulls, oat hulls, palm kernel, and citrus pulp; c) protein obtained from sources such as soya, sunflower, peanut, lupin, peas, fava beans, cotton, canola, fish meal, dried plasma protein, meat and bone meal, potato protein, whey, copra, sesame; d) oils and fats obtained from vegetable and animal sources; and e) minerals and vitamins.

One or more subtilisin variant described herein finds further use in the enzyme aided bleaching of paper pulps such as chemical pulps, semi-chemical pulps, kraft pulps, mechanical pulps or pulps prepared by the sulfite method. In general terms, paper pulps are incubated with one or more subtilisin variant described herein under conditions suitable for bleaching the paper pulp.

In some embodiments, the pulps are chlorine free pulps bleached with oxygen, ozone, peroxide or peroxyacids. In some embodiments, one or more subtilisin variant described herein is used in enzyme aided bleaching of pulps produced by modified or continuous pulping methods that exhibit low lignin contents. In some other embodiments, one or more subtilisin variant described herein is applied alone or preferably in combination with xylanase and/or endoglucanase and/or alpha-galactosidase and/or cellobiohydrolase enzymes.

In other embodiments, one or more subtilisin variant described herein finds further use in the enzyme aided debridement of tissue. This involves the removal of dead or damaged tissue, for example, removal from wounds to aid in healing.

In even further embodiments, one or more subtilisin variant described herein finds further use in tissue culture. In particular, one or more subtilisin variant described herein can be used to suspend or resuspend cells adherent to a cell culture wall, such as during the process of harvesting cells. In another embodiment, one or more subtilisin variant described herein can be used to cleave protein bonds between cultured cells and the dish, allowing cells to become suspended in solution.

In yet another embodiment, one or more subtilisin variant described herein finds further use as a food additive, a digestive aide, and/or a food processing aid.

In still yet another embodiment, one or more subtilisin variant described herein finds further use in leather processing by removing hair from animal hides, soaking, degreasing, or bating, which is a process involving degradation of non-structural proteins during leather making.

EXAMPLE 1

Assays

The following assays were used in the examples that follow. Any deviations from the assays described herein below will be addressed in the example in which such deviation arises.

Performance Index

The performance index (PI) of an enzyme compares the performance of a variant (measured value) with a Parent enzyme selected from AprL wild-type (WT) (SEQ ID NO:2) (hereinafter "AprL Parent"), BliD02339 WT (SEQ ID NO:9) (hereinafter "BliD Parent"), or SQCBV35 variant (SEQ ID NO:63) (hereinafter SQCBV35 Parent) (theoretical value or measured value) at the same protein concentration. Theoretical concentrations for the Parent can be calculated using the parameters extracted from a Langmuir fit of a standard curve of the Parent. A PI that is greater than 1 (PI>) indicates improved performance by a variant as compared to Parent, while a PI of 1 (PI=1) identifies a variant that performs the same as Parent, and a PI that is less than 1 (PI<1) identifies a variant that performs worse than Parent.

Protein Determination Assay

Protein determination of AprL or BliD Variants from culture supernatant was performed with an Agilent U-HPLC or HPLC systems. For U-HPLC method, a calibration curve (0-500 ppm) of purified Parent protein was prepared and used to generate a standard curve. AprL or BliD Variants from clarified culture supernatants were diluted 10 fold in the dilution buffer (Tris 25 mM, pH 7.4, 5 mM $CaCl_2$) and then mixed in a 1:1 ratio with an Acetonitrile buffer (22.5 mM Tris, pH 7.4, 4.5 mM $CaCl_2$, 9% acetonitrile). Afterwards, the samples were filtered using a 45 μm filterplate and loaded via an auto-sampler onto a reverse phase column (Zorbax 300 SB-C3 column, 2.1×100 mm & 2.1×50 mm, both with 1.8 μm beadsize). The samples were eluted from the column with a gradient of Buffer A (0.1% Trifluoroacetic acid (TFA)) and Buffer B (0.07% Acetonitrile). The flow rate was 1 mL/min with a 4 min run and a 1 min post run column equilibration. Absorbance was measured at 220 nm, and peaks were integrated using ChemStation software (Agilent Technologies). The protein concentration of the samples was calculated based on a standard curve of the purified Parent.

In some instances, the Bradford method for protein determination was used alongside with HPLC. The Bradford reagent (Bradford Quickstart 1× dye reagent, BioRad) was used and absorbance at 595/450 nm was measured on a Spectramax plate reader.

Alternately, protein determination of AprL variants from culture supernatant was performed by HPLC, using an Agilent 1100/1200 system. A calibration curve (0-1500 ppm) using purified Parent protein was prepared and used to generate a standard curve. AprL Variants from clarified culture supernatants were analysed by one of two methods. In some cases, the culture supernatants were diluted two fold in the dilution buffer (Tris 100 mM, pH 8.6, 0.005% Tween 80) and loaded via an auto-sampler onto an Agilent C8 column (Agilent Poroshell 5 μm 300SB-C8 2.1×75 mm) pre-equilibrated at 69-70° C. The samples were eluted from the column with a gradient of Buffer A (0.1% TFA) and Buffer B (100% Acetonitrile and 0.1% TFA). The flow rate was 2 mL/min with a 2 min run. In other cases, clarified culture supernatants containing AprL Variants were pre-treated in an acid/SDS solution. 75 μL samples were mixed with 6.4 μL of a 4NHCl and mixed for 10 minutes on ice. 20.4 μL 10% SDS solution was added per well and mixed, samples were filtered prior to loading into HPLC HIP-ALS Aquity 125A USEC column set at room temperature. The samples were eluted with a solution of 25 mM Na-acetate, pH 5.5, 100 mM NaCl, 0.5% SDS at a flow rate was 0.35 mL/min with an 8 min run. Absorbance was measured at 220 or 230 nm, and peaks were integrated using ChemStation (Agilent Technologies) software.

For all three protein determination methods, the protein concentration of each sample was calculated based on a standard curve of the purified Parent enzyme.

Protease Activity

The protease activity of Parent and variants thereof was tested by measuring the hydrolysis of N-suc-AAPF-pNA or dimethylcasein (DMC) substrates.

For the AAPF assay, the reagent solutions used were: 100 mM Tris pH 8.6, 10 mM $CalCl_2$, 0.005% Tween®-80 (Tris/Ca buffer) and 160 mM suc-AAPF-pNA in DMSO (suc-AAPF-pNA stock solution) (Sigma: S-7388). To prepare a working solution, 1 mL suc-AAPF-pNA stock solution was added to 100 mL Tris/Ca buffer and mixed. An enzyme sample was added to a microtiter plate (MTP) containing 1 mg/mL suc-AAPF-pNA working solution and assayed for activity at 405 nm over 3-5 min using a SpectraMax plate reader in kinetic mode at RT. The protease activity was expressed as mOD/min.

For the DMC assay, the reagent solutions used were: 2.5% DMC (Sigma) in 100 mM Sodium Carbonate pH 9.5, 0.075% TNBSA (2,4,6-trinitrobenzene sulfonic acid, Thermo Scientific) in Reagent A. Reagent A: 45.4 g $Na_2B_4O_7.10H_2O$ (Merck) in 15 mL 4N NaOH to reach a final volume of 1000 mL in MQ water, Dilution Solution: 10 mM NaCl, 0.1 mM $CaCl_2$, 0.005% Tween-80, 0.02% Na-azide. MTPs were filled with 47.5 uL DMC substrate following the addition of 2.5 uL of 20 ppm protease supernatant. 50 uL of TNBSA in Reagent A was then added with slow mixing. Activity was measured at 405 nm over 5 min using a SpectraMax plate reader in kinetic mode at RT. As stated above for the AAPF assay, activity was expressed as mOD/min.

Detergent Compositions Evaluated

Detergent formulas used in these studies are listed in Table 1, and include heavy duty liquid laundry (HDL), heavy duty power laundry (HDD), and automatic dishwashing (ADW) formulas. Commercial detergents were heat-inactivated to remove enzyme activity and dosed as described in Table 1. Detergent treatments for enzyme inactivation were as follows. HDL laundry detergents that contain enzymes (excludes Test HDL 1, Test HDL 2, and Persil Non-Bio HDL detergents) were inactivated by heating the neat liquid at 95° C. for 16 hours in a water bath. Enzymes in HDD detergents were inactivated by preparing a 10× concentrated solution relative to what is used in the final cleaning assay and heating for 16 hours at 95° C. Commercial ADW detergent formulas were heat inactivated for 30-45 min at 65° C. as follows. An ADW detergent tablet was dissolved in 700 mL 21GH water and enzyme activity was inactivated by incubating the solution for 30-45 min at 65° C. The enzyme inactivated solution was diluted 10 fold in 21GH water prior to use in the assays. Protease activity was assayed following inactivation using the AAPF substrate to ensure complete protease enzyme inactivation. Protease activity was not detectable after the heat treatment of HDD, ADW and HDL detergents. The HDL detergents; Persil Non-Bio, Test HDL 1 and Test HDL 2 are considered boron-free since they contained ≤5 mg/Kg of boron, when tested for elemental boron content. GSM-B powder formula was dissolved to 3 g/L for use and pH was not adjusted.

Detergent sources: ALL, Kirkland Ultra and Kirkland Ultraclean (SunProducts), OMO Color, OMO Klein & Krachtig, Surf Excel, and SUN All in One detergent tablets (Unilever). Finish All in One and Finish Quantum detergent tablets (Reckitt Benckiser), and Blue Moon(Guangzhou Blue Moon). Detergents listed above were purchased from local supermarkets in 2012. Persil Small &Mighty Non-Bio Liquid Detergent "Persil Non-Bio" (Unilever) was purchased in 2014. Liby (Guangzhou Liby Enterpise) was purchased in 2016. Test HDL and Test HDL 2 detergents we custom-made in house and the composition of each is set forth in Tables 1.2 and 1.3, respectively. Table 1.4 shows the composition of the GSM-B Phosphate-free ADW detergent (purchased without enzymes, from WFK Testgewebe GmbH, Brüggen, Deutschland, www.testgewebe.de). GSM-B 9 formula was prepared by adjusting pH of purchased GSM-B Phosphate-free detergent down to pH9. Table 1.5 shows the composition of Custom Liquid ADW Detergent Formula adjusted to pH and pH9 for testing.

TABLE 1.2

Composition Of Custom-made Test HDL 1 Detergent Formula

| Component | Ingredient | Trade name | Wt. % |
|---|---|---|---|
| Solvent | Water (total) | — | 64.89 |
| Surfactant | C12-C15 Pareth-7 (Sodium) | Empilan KCL 7 | 3 |
| | Dodecylbenzenesulfonate | NANSA SSA F | 7.5 |
| | K-Cocoate | NANSA PC 38F | 3 |
| | Sodium Laureth Sulfate | Empicol ESB3/M6 | 9 |
| Builder | Sodium Citrate | Sodium Citrate Tribasic Dihydrate | 3 |
| Liquid properties/ stability | Sorbitol | D-Sorbitol | 0.8 |
| | Propylene glycol | 1,2-Propanediol | 2.5 |
| | Glycerin | Glycerol | 0.8 |
| | Triethanolamine | Triethanolamine | 0.5 |

TABLE 1.1

List of Detergents And Conditions Used For Cleaning Performance Assays

| Assay Condition | Detergent | Type | Final Wash Conc, (g/L) | Hardness Conc. (ppm) | Buffer | *Set pH |
|---|---|---|---|---|---|---|
| 1 | Kirkland Ultra | HDD | 1.09 | 150 | 2 mM $NaCO_3$ | 10.6 |
| 2 | OMO Color | HDD | 5.3 | 250 | 2 mM $NaCO_3$ | 10.6 |
| 3 | Surf Excel | HDD | 4 | 400 | 2 mM $NaCO_3$ | 10.6 |
| 4 | Kirkland Ultraclean | HDL | 0.17 | 150 | 5 mM sodium HEPES | 8.2 |
| 5 | OMO Klein & Krachtig | HDL | 2.8 | 250 | 5 mM HEPES | 8.2 |
| 6 | Blue Moon HDL | HDL | 1.33 | 100-250 | 5 mM HEPES | 6.5-8.2 |
| 7 | ALL | HDL | 0.17 | 150 | 5 mM HEPES | 8.2 |
| 8 | Test HDL1 | HDL | 7.5 | 200-250 | 5 mM HEPES | 8.2 |
| 9 | Test HDL 2 | HDL | 0.84 | 100-150 | 5 mM HEPES | 8.2 |
| 10 | Persil Non-Bio | HDL | 2.7 | 200-250 | 5 mM HEPES | 8.2 |
| 11 | GSM-B pH 10.5 | ADW | 3 | 374 ppm | not buffered | ND |
| 12 | GSM-B pH 9 | ADW | 3 | 374ppm | 1M citrate added | 9 |
| 13 | SUN ® All in 1 | ADW | 1 tablet dissolved, diluted 10X | 374 ppm | Not buffered | ND |
| 14 | Finish ® Quantum | ADW | 1 tablet dissolved, diluted 10X | 374 ppm | Not buffered | ND |
| 15 | Finish ® All-in-1 | ADW | 1 tablet dissolved, diluted 10X | 374 ppm | Not buffered | ND |
| 16 | Liby | HDL | 0.89 | 100 | 5 mM HEPES | 8.2 |
| 17 | Custom Liquid ADW detergent | ADW | 3 | 374 ppm | 20 mM TRIS base | 7 |
| 18 | Custom Liquid ADW detergent | ADW | 3 | 374 ppm | 20 mM TRIS base | 9 |

*pH of wash solution was adjusted for detergents where value is provided and not for those marked ND.

TABLE 1.2-continued

Composition Of Custom-made Test HDL 1 Detergent Formula

| Component | Ingredient | Trade name | Wt. % |
|---|---|---|---|
| | Methylisothiazolinone | 2-Methyl-4-isothiazolin-3-one | 0.01 |
| | Ethanol | — | 1 |
| Neutralizer | NaOH (4M) | — | 5.27 |

TABLE 1.3

Composition Of Custom-made Test HDL 2 Detergent Formula

| Component | Ingredient | Trade name | Wt. % |
|---|---|---|---|
| Solvent | Water (total) | — | QS |
| | Propylene glycol | — | 5 |
| Surfactant | Sodium Alkyl Aryl Ether Sulfate | Polystep B27 (30% active) | 12 |
| | Sodium alkylbenzene sulfonate | Nacconal 90G | 1.2 |
| Builder | Trisodium citrate | — | 0.5 |
| | Na2EDTA | — | 0.25 |
| Liquid properties/ stability | Sodium formate | — | 0.25 |
| | Acrylic acid homopolymer | Sokalan PA 30 CL (50% active) | 0.5 |
| | Oleic acid | — | 1 |
| | Calcium chloride | — | 0.1 |
| | Brightener | Tinopal CBS-X | 0.25 |
| | Preservative | Bioban 425 (25% active) | 0.04 |
| Neutralizer | Sodium carbonate | — | 0.25 |
| | Sodium Hydroxide (50%) to pH 8.5 | — | 0.25 |

TABLE 1.4

Composition Of GSM-B Phosphate-Free Detergent (GSM-B, pH 10.5)

| Component | Wt % |
|---|---|
| Sodium citrate dehydrate | 30.0 |
| Maleic acid/acrylic acid copolymer sodium Salt (SOKALAN ® CP5; BASF) | 12.0 |
| Sodium perborate monohydrate | 5.0 |
| TAED | 2.0 |
| Sodium disilicate: Protil A (Cognis) | 25.0 |
| Linear fatty alcohol ethoxylate | 2.0 |
| Sodium carbonate anhydrous | add to 100 |

TABLE 1.5

Composition of Custom Liquid ADW Detergent. Formula adjusted to pH 7 and pH 9 for testing.

| Component | Weight % |
|---|---|
| GLDA (Dissolvine) | 37 |
| Glycerine (116) | 10 |
| Citric acid monohydrate (38) | 4.0 |
| Sodium Citrate tribasic dihydrate | 3.0 |
| Plurafac LF301 (277) | 2.0 |
| Propylene Glycol | 1.0 |
| Bayhibit S | 0.25 |
| Xanthane gom (275) | 0.7 |
| Acusol 460N 587 (238) | 0.7 |
| Water | 41.55 |

Cleaning Performance in Laundry (HDL and HDD) and ADW Detergents

Variants were tested for cleaning performance relative to Parent on various technical soils; BMI (EMPA-116, blood/milk/ink on cotton), egg (CS-38, egg yolk with pigment aged by heat), and POM (CFT-C10, pigment/oil/milk) for laundry-based applications, and on egg yolk (PAS-38, egg yolk on polyacryl fabric, aged and colored with carbon black dye) for dish-based applications. The EMPA-116, CS-38, and CFT-C10 swatches were pre-rinsed with deionized water for 20 minutes and dried overnight at room temperature. The PAS-38 fabric was pre-rinsed with 10 mM CAPS buffer (pH 1) at 60C for 30 min at 900 rpm in an iEMS shaker, rinsed with 2 ml deionized water and dried overnight. For all stains, pre-punched swatches in MTP plates (Corning 3641) were prepared by Center for Testmaterials BV, Vlaardingen, Netherlands. These microswatch-containing plates were filled with detergent prior to enzyme addition.

General Sample Set-Up for Stability Assays

Variants were tested for stability under various stress conditions (buffers and detergents as indicated in Table 2 below) by measuring the residual activity following incubation at elevated temperature. The elevated temperature was set to obtain approximately 30% residual activity of the stressed sample compared to the unstressed sample. Diluted enzyme sample was mixed in stressor and unstressed protease activity was measured. The diluted sample in stressor was incubated at elevated temperatures and for time periods listed in Table 2 followed by measurement of the stressed protease activity either by AAPF or DMC hydrolysis. Detergent enzymes were heat inactivated as described above, prior to use in stability assays.

TABLE 2

Reagents And Conditions Used For Protease Stability Assays

| Assay Condition | Detergent or Buffer | Stress temperature (° C.) | Incubation time (min) |
|---|---|---|---|
| 1 | 0.02% LAS, 2.1 mM EDTA in 50 mM HEPES pH 8, 0.005% Tween | 53.5 | 5 |
| 2 | 10% Kirkland Ultra | 56 | 5 |
| 3 | 10% OMO Klein & Krachtig | 51 | 5 |
| 4 | 50 mM Tris pH 9; 1 mM EDTA, 0.005% Tween | 51 | 5 |
| 5 | 10% Test HDL 1 | 52-55 or 60 | 5 or 15-20 |
| 6 | 10% Persil Non-Bio, Small & Mighty | 62-63 or 66 | 15-20 |
| 7 | 10% Blue Moon | 64 or 68 | 15-20 |
| 8 | 10% Liby | 65 or 69 | 15-20 |

For the unstressed condition, enzyme was assayed immediately for activity on AAPF or DMC (see above). For the stressed condition, the PCR plate was sealed and incubated at elevated temperature for 5 min using an Eppendorf 385 MasterCycler Pro Thermocycler or PTC-200 Peltier thermal cycler, then assayed for activity. Stressed and unstressed activity was measured by either the hydrolysis of the synthetic substrate or by the DMC method, as described above. % residual activities were calculated by taking a ratio of the stressed to unstressed activity and multiplying by 100. Stability PIs were obtained by dividing the residual activity of a variant by that of the Parent.

Aliquots of enzyme were added to detergent-filled MTPs containing microswatches to reach a final volume of 200 uL for laundry assays with a final enzyme concentration between 0.5-5 ppm. Laundry cleaning assays with HDL or HDD formulas were carried out at 25° C. for 15-30 min, while ADW assays were carried out at 40° C. for 30 min.

Following incubation, 100-150 uL of supernatant was transferred to a fresh MTP and absorbance was read at 600 nm for EMPA-116 swatches or at 405 nm for CS-10, CS-38, and PAS-38 swatches using a SpectraMax plate reader. Absorbance results were obtained by subtracting the value for a blank control (no enzyme) from each sample value. The cleaning PI for each assay condition was obtained by dividing the absorbance values for a given variant by that of the predicted Parent at the same concentration. The Parent value was determined by fitting the standard curve of the purified Parent sample to a Langmuir fit.

Aged Laundry Cleaning Assay (A) MTP assay: Each well of a 96-well MTP was filled with a mini stir disc followed by addition of 270 uL 100% Persil Non-Bio detergent. 18.1 uL of enzyme supernatant diluted to ~500 ppm was added to the detergent-filled MTP and mixed using a magnetic tumbling mixing apparatus (V&P Scientific. VP710 series) for 5 min. For the initial time point (T=0). 25 uL of enzyme containing detergent was transferred to a MTP filled with 125 uL of buffer (5 mM HEPES, 250 ppm 3:1 Ca:Mg water hardness, pH 8). 5 uL aliquots of enzyme diluted in detergent was then added to 185 uL buffer (5 mM HEPES, 250 ppm hardness, pH 8) previously added to a MTP containing an EMPA-116 BMI microswatch. At time point 0 (T=0), the cleaning assay was carried out in an analogous manner as described above for fresh cleaning. For the remaining time points, the detergent-enzyme plate was incubated at 37° C. for 3 days or 3 weeks or 55° C. for either: 1.5 h, 5 h, or 24 h; aliquots were removed at the end of each time point; and the cleaning assay carried out in an analogous manner as described above for fresh cleaning. A residual cleaning value was obtained by comparing the cleaning at the various remaining time points to the initial cleaning at T=0.

(B) Conical tube Assay: Clarified enzyme culture supernatant and 100% Test HDL 1 detergent were added to 15 mL Polystyrene centrifuge tubes at a final volume of 1.1 mL to achieve a final enzyme concentration of 88 ppm in detergent. 5 uL samples for each variant were immediately withdrawn from tube and frozen for assaying later as the initial time point (T=0). Samples were incubated at 37° C. for 3 days. Following incubation, 5 uL samples were withdrawn and frozen. To prepare samples for the cleaning assay, all samples were thawed and 660 uL of buffer (5 mM HEPES, 250 ppm 3:1 Ca:Mg water hardness, pH 8) was added to the samples. 200 uL aliquots of the diluted samples were added to a MTP containing an EMPA-116 BMI microswatch. Laundry cleaning assays were carried out at 25° C. for 60 min in an iEMS incubator shaking at 1400 rpm. Following incubation, 120 uL of supernatant was transferred to a fresh MTP and absorbance was read at 600 nm using the SpectraMax plate reader. Absorbance results were obtained by subtracting the value for a blank control (no enzyme) from each sample value. Residual cleaning for each variant was calculated as the ratio of cleaning remaining after 3 days to the cleaning at T=0 and reported as percent remaining cleaning

EXAMPLE 2

Combinatorial Design and Expression of AprL-Clade Protease Variants

*Bacillus* sp. AprL and *B. licheniformis* Bra7 BliD02339 subtilisins, which are both members of the AprL-clade, were modified to produce AprL-Clade protease variants with improved cleaning performance and detergent stability. The AprL-clade is more fully described in International Appl. No. PCT/US16/32514, filed May 13, 2016, and published as WO2016183509.

The amino acid sequence of the mature AprL Parent enzyme is set forth as SEQ ID NO:2. A synthetic gene (SEQ ID NO:1) encoding the AprL Parent protease was synthesized by GeneArt, Life Technologies and used for generating variant sequences utilizing conventional molecular biology techniques (see, e.g., Sambrook et al, "Molecular Cloning", Cold Spring Harbor Laboratory Press). Genes encoding AprL variants were also synthesized. The various AprL genes were then cloned into the pHYT expression vector (derived from pHY300PLK (Takara-Clontech)). The expression vector contained the aprE promoter (SEQ ID NO:3), aprE signal peptide (SEQ ID NO:4), AprL propeptide (SEQ ID NO:5), and BPN' terminator sequences (SEQ ID NO:6). DNA fragments encoding the various mature protease sequences of interest (wild-type and variants) were introduced using techniques known in the art. A suitable *B. subtilis* host strain was transformed with the expression plasmids containing the AprL Parent and protease variant gene sequences. The cells were grown in 96-well MTPs in cultivation medium (enriched semi-defined media based on MOPs buffer, with urea as major nitrogen source, glucose as the main carbon source, supplemented with 1% soytone for robust cell growth, containing antibiotic selection) for 2 days at 32° C., 300 rpm, with 80% humidity in shaking incubator. After centrifugation and filtration, clarified culture supernatants containing the proteases of interest were used for assays. The same process was used for construction of the BliD02339 wild-type and variant expression cassettes, subsequent *B. subtilis* host strain transformations and cultivation.

In some instances, the AprL variants were generated from an integration cassette that targets the *B. subtilis* aprE locus. Pools of DNA encoding the genes of interest were introduced into an expression cassette that was later integrated into the chromosome of a suitable *B. subtilis* strain using methods known in the art. DNA fragments containing the following elements: BPN' terminator (SEQ ID NO: 6), chloramphenicol resistance marker from *Staphylococcus aureus* (SEQ ID NO:165), *B. subtilis* aprE promoter (SEQ ID NO:3), *B. subtilis* aprE signal peptide sequence (SEQ ID NO:4), and AprL propeptide (SEQ ID NO:5) were part of the expression cassette. The transformed cells were cultured as described above, and proteins of interest were similarly isolated

EXAMPLE 3

Performance Evaluation of AprL Variants in Laundry Application

Variants of AprL Parent protease (SEQ ID NO:2) (hereinafter "AprL Variants"), prepared as described in Example 2 and listed in Table 3, were evaluated for cleaning performance and stability as described in Examples 3-7.

The AprL variants described in Table 3 were tested in the Laundry cleaning performance assay described in Example 1 using EMPA-116 BMI soil and the following laundry detergents: Kirkland Ultra HDD, OMO Color HDD, Surf Excel, Kirkland Ultraclean HDL, OMO Klein &Krachtig HDL, and Blue Moon HDL. The Table 3 AprL Variants with a PI>1.1 versus AprL Parent are listed in Table 4.

TABLE 3

AprL Variants Evaluated in Examples 3-7.

| Sample ID | Sequence Substitutions Relative To AprL Parent | SEQ ID NO: |
|---|---|---|
| SQM-002 | M123I-Q136R | 10 |
| SQM-003 | P9E-M123I | 11 |
| SQM-004 | V45R-M123I | 12 |
| SQM-005 | G127T-G165S-T210E | 13 |
| SQM-006 | M123I-G165S-N239S | 14 |
| SQM-007 | M123I-Q136R-G165Q | 15 |
| SQM-008 | M123I-Q136R-S258E | 16 |
| SQM-009 | M123I-V146S-T210E | 17 |
| SQM-010 | P9E-V45R-M123I | 18 |
| SQM-011 | Q136R-G165Q-S258E | 19 |
| SQM-012 | V45R-M123I-Q136R | 20 |
| SQM-013 | G127T-V146S-G165S-N239S | 21 |
| SQM-014 | L10M-K27R-S98H-M123I | 22 |
| SQM-015 | M123I-Q136R-G165Q-S258E | 23 |
| SQM-016 | M123I-V146S-G165S-T210P | 24 |
| SQM-017 | M123I-V146S-T210P-S250G | 25 |
| SQM-018 | P9E-M123I-Q136R-G165Q | 26 |
| SQM-019 | P9E-Q136R-G165Q-S258E | 27 |
| SQM-020 | P9E-V45R-M123I-Q136R | 28 |
| SQM-021 | V45R-M123I-Q136R-G165Q | 29 |
| SQM-022 | V45R-M123I-Q136R-S258E | 30 |
| SQM-023 | V45R-Q136R-G165Q-S258E | 31 |
| SQM-024 | K27R-N43A-S98H-M123I-T210H | 32 |
| SQM-026 | P9E-M123I-Q136R-G165Q-S258E | 33 |
| SQM-027 | P9E-V45R-M123I-Q136R-G165Q | 34 |
| SQM-028 | P9E-V45R-M123I-Q136R-S258E | 35 |
| SQM-029 | V45R-M123I-Q136R-G165Q-S258E | 36 |
| SQM-030 | Y103I-G127T-V146S-G165S-N239S | 37 |
| SQM-031 | T77H-V87T-M123I-Q136R-N184Q-N239S | 38 |
| SQM-032 | T77H-V87T-M123I-Q136R-G165Q-N184Q-N239S | 40 |
| SQM-034 | T77S-V87S-M123I-Q136R-G165Q-S187P-S258P | 41 |
| SQM-035 | T77S-V87S-M123I-Q136R-N160C-S187P-S258P | 42 |
| SQM-036 | T77H-V87T-M123I-Q136R-N184Q-S187P-N239S-S258P | 43 |
| SQM-037 | T3Q-K22Y-A24N-V45I-A48I-T77N-N217S-L234I-Y255R | 44 |
| SQM-038 | P9E-T77Q-V87T-M123I-Q136R-G165Q-N184Q-N217S-N239S-S258E | 45 |
| SQM-039 | N43A-V45R-T77H-V87T-M123I-Q136R-G165A-N184Q-S187P-N239S-S258P | 46 |
| SQM-040 | P9E-N43A-V45R-T77S-V87S-M123I-Q136R-G165Q-S187P-N217S-S258P | 47 |
| SQM-041 | P9E-N43A-V45R-T77H-V87T-M123I-Q136R-G165Q-N184Q-S187P-N239S-S258P | 48 |
| SQM-042 | P9E-N43A-V45R-T77Q-V87T-M123I-Q136R-G165Q-N184Q-N217S-N239S-S258E | 49 |
| SQM-043 | P9E-N43A-V45R-T77H-V87T-M123I-Q136R-G165A-N184Q-S187P-N217S-N239S-S258E | 50 |
| SQM-044 | | |

TABLE 4

AprL Variants With Improved Laundry Cleaning Performance on BMI Stain in at Least One Detergent.

| | HDL | | | HDD | | |
|---|---|---|---|---|---|---|
| Sample ID | Blue Moon | Kirkland | OMO | Kirkland | OMO | Surf |
| SQM-002 | 0.81 | 1.02 | 0.96 | 1.63 | 1.01 | 1.27 |
| SQM-003 | 0.96 | 0.97 | 1.03 | 1.25 | 0.62 | 0.62 |
| SQM-004 | 0.91 | 1.06 | 1.31 | 1.7 | 0.46 | 1.2 |
| SQM-007 | 0.54 | 1.22 | 0.93 | 1.65 | 1.51 | 1.29 |
| SQM-008 | 0.66 | 1.19 | 0.93 | 1.78 | 1.22 | 1.26 |
| SQM-010 | 0.91 | 1.15 | 1.01 | 0.94 | 0.5 | 0.66 |
| SQM-012 | 0.59 | 0.98 | 0.89 | 2.17 | 1.67 | 1.53 |
| SQM-016 | 0.48 | 0.58 | 0.46 | 1.56 | 1.32 | 1.3 |
| SQM-019 | 0.47 | 0.98 | 0.64 | 1.51 | 0.96 | 1.13 |
| SQM-021 | 0.85 | 1.32 | 1.15 | 1.88 | 1.26 | 1.22 |
| SQM-022 | 0.5 | 0.82 | 0.64 | 1.14 | 0.86 | 1.00 |
| SQM-023 | 0.76 | 1.34 | 0.98 | 1.65 | 1.65 | 1.24 |
| SQM-024 | 0.59 | 0.74 | 0.67 | 1.34 | 1.29 | 1.13 |
| SQM-028 | 0.46 | 0.99 | 0.76 | 2.21 | 1.78 | 1.49 |
| SQM-029 | 0.46 | 0.96 | 0.65 | 1.41 | 1.04 | 1.23 |
| SQM-030 | 0.55 | 0.87 | 0.7 | 1.26 | 1.01 | 1.03 |

EXAMPLE 4

Performance Evaluation of AprL Variants in Dishwashing Application

The AprL variants described in Table 3 were tested in the ADW cleaning performance assay described in Example 1 using PAS-38 egg yolk soil and the following ADW detergents: GSM-B pH 10, GSM-B pH 9, SUN® All in One, Finish® Quantum, and Finish® All in One. AprL variants (listed on Table 3) with a PI>1.01 versus AprL Parent in at least one of these ADW detergents are listed in Table 5. The Table 3 AprL variants with PI>1.01 versus AprL Parent in all of these ADW detergents are listed in Table 6.

TABLE 5

AprL Variants With Improved ADW Cleaning Performance on Egg Stain in at Least One detergent

| Sample ID | Finish® ALL in One | GSMB pH 10 | GSMB pH 9 | Finish® Quantum | SUN® All in One |
|---|---|---|---|---|---|
| SQM-002 | 1.17 | 1.12 | 1.2 | 1.15 | 1.26 |
| SQM-003 | 0.61 | 0.59 | 1.03 | 0.89 | 0.68 |
| SQM-004 | 0.97 | 0.89 | 1.38 | 1.21 | 0.94 |
| SQM-007 | 1.2 | 1.15 | 1.2 | 1.03 | 1.32 |

TABLE 5-continued

AprL Variants With Improved ADW Cleaning Performance on Egg Stain in at Least One detergent

| Sample ID | Finish ® ALL in One | GSMB pH 10 | GSMB pH 9 | Finish ® Quantum | SUN ® All in One |
|---|---|---|---|---|---|
| SQM-008 | 0.75 | 1.02 | 1.14 | 1.15 | 0.97 |
| SQM-010 | 0.68 | 0.69 | 1.01 | 1.19 | 0.72 |
| SQM-012 | 1.1 | 1.03 | 1.3 | 1.12 | 1.18 |
| SQM-016 | 1.21 | 1.19 | 1.26 | 1.24 | 1.11 |
| SQM-019 | 0.98 | 0.85 | 1.07 | 0.88 | 1.1 |
| SQM-020 | 0.92 | 0.82 | 0.76 | 1.03 | 0.9 |
| SQM-021 | 0.96 | 0.92 | 1.25 | 1.07 | 1.07 |
| SQM-022 | 1.14 | 1.1 | 1.09 | 1.00 | 1.17 |
| SQM-023 | 0.84 | 0.87 | 1.04 | 0.9 | 0.89 |
| SQM-024 | 1.13 | 1.04 | 1.15 | 1.06 | 1.07 |
| SQM-028 | 1.38 | 1.31 | 1.45 | 1.18 | 1.44 |
| SQM-029 | 0.9 | 0.88 | 1.05 | 1.02 | 1.00 |
| SQM-030 | 1.07 | 1.12 | 1.12 | 1.03 | 1.17 |

TABLE 6

AprL Variants With Improved ADW Cleaning Performance on Egg Stain.

| Sample ID | Finish ® All in One | GSMB pH 10 | GSMB pH 9 | Finish ® Quantum | SUN ® All in One |
|---|---|---|---|---|---|
| SQM-002 | 1.17 | 1.12 | 1.2 | 1.15 | 1.26 |
| SQM-007 | 1.2 | 1.15 | 1.2 | 1.03 | 1.32 |
| SQM-012 | 1.1 | 1.03 | 1.3 | 1.12 | 1.18 |
| SQM-016 | 1.21 | 1.19 | 1.26 | 1.24 | 1.11 |
| SQM-022 | 1.14 | 1.1 | 1.09 | 1.00 | 1.17 |
| SQM-024 | 1.13 | 1.04 | 1.15 | 1.06 | 1.07 |
| SQM-028 | 1.38 | 1.31 | 1.45 | 1.18 | 1.44 |
| SQM-030 | 1.07 | 1.12 | 1.12 | 1.03 | 1.17 | mance assays described in Example 1 are listed in Table 7. The Table 3 AprL variants with P>1.1 versus AprL Parent in at least one Laundry (HDL or HDD), ADW, or Stability assay described in Example 1 are listed in Table 8.

TABLE 7

AprL Variants With Improved Stability.

| Sample ID | LAS/EDTA | OMO | Kirkland |
|---|---|---|---|
| SQM-002 | 1.04 | 1.35 | 1.32 |
| SQM-003 | 1.31 | 1.02 | 0.88 |
| SQM-004 | 1.02 | 1.25 | 0.76 |
| SQM-007 | 2.01 | 1.68 | 2.06 |
| SQM-008 | 1.51 | 1.38 | 1.39 |
| SQM-010 | 1.21 | 1.46 | 0.85 |
| SQM-011 | 2.67 | 1.8 | 2.09 |
| SQM-012 | 1.01 | 1.07 | 1.19 |
| SQM-016 | 2.16 | 1.87 | 1.94 |
| SQM-020 | 2.92 | 1.83 | 2.31 |
| SQM-021 | 1.11 | 1.47 | 1.00 |
| SQM-022 | 1.45 | 1.68 | 1.87 |
| SQM-023 | 1.55 | 1.42 | 1.32 |
| SQM-024 | 2.31 | 1.63 | 2.39 |
| SQM-027 | 2.39 | 1.9 | 2.07 |
| SQM-028 | 1.81 | 1.59 | 1.47 |
| SQM-029 | 1.41 | 1.58 | 1.23 |
| SQM-030 | 1.84 | 1.83 | 2.11 |

TABLE 8

AprL Variants With Improved Cleaning Performance and Stability.

| | HDL, BMI | | | HDD, BMI | | | ADW, EGG | | | | | Stability | | |
|---|---|---|---|---|---|---|---|---|---|---|---|---|---|---|
| Sample ID | Blue Moon | Kirkland | OMO | Kirkland | OMO | Surf | Finish ® All-in-1 | GSMB pH 10 | GSMB pH 9 | Finish ® Quantum | SUN | LAS/EDTA | OMO | Kirkland |
| SQM-002 | 0.81 | 1.02 | 0.96 | 1.63 | 1.01 | 1.27 | 1.17 | 1.12 | 1.2 | 1.15 | 1.26 | 1.04 | 1.35 | 1.32 |
| SQM-004 | 0.91 | 1.06 | 1.31 | 1.7 | 0.46 | 1.2 | 0.97 | 0.89 | 1.38 | 1.21 | 0.94 | 1.02 | 1.25 | 0.76 |
| SQM-007 | 0.54 | 1.22 | 0.93 | 1.65 | 1.51 | 1.29 | 1.2 | 1.15 | 1.2 | 1.03 | 1.32 | 2.01 | 1.68 | 2.06 |
| SQM-008 | 0.66 | 1.19 | 0.93 | 1.78 | 1.22 | 1.26 | 0.75 | 1.02 | 1.14 | 1.15 | 0.97 | 1.51 | 1.38 | 1.39 |
| SQM-010 | 0.91 | 1.15 | 1.01 | 0.94 | 0.5 | 0.66 | 0.68 | 0.69 | 1.01 | 1.19 | 0.72 | 1.21 | 1.46 | 0.85 |
| SQM-012 | 0.59 | 0.98 | 0.89 | 2.17 | 1.67 | 1.53 | 1.1 | 1.03 | 1.3 | 1.12 | 1.18 | 1.01 | 1.07 | 1.19 |
| SQM-016 | 0.48 | 0.58 | 0.46 | 1.56 | 1.32 | 1.3 | 1.21 | 1.19 | 1.26 | 1.24 | 1.11 | 2.16 | 1.87 | 1.94 |
| SQM-021 | 0.85 | 1.32 | 1.15 | 1.88 | 1.26 | 1.22 | 0.96 | 0.92 | 1.25 | 1.07 | 1.07 | 1.11 | 1.47 | 1.00 |
| SQM-022 | 0.5 | 0.82 | 0.64 | 1.14 | 0.86 | 1.00 | 1.14 | 1.1 | 1.09 | 1.00 | 1.17 | 1.45 | 1.68 | 1.87 |
| SQM-024 | 0.59 | 0.74 | 0.67 | 1.34 | 1.29 | 1.13 | 1.13 | 1.04 | 1.15 | 1.06 | 1.07 | 2.31 | 1.63 | 2.39 |
| SQM-028 | 0.46 | 0.99 | 0.76 | 2.21 | 1.78 | 1.49 | 1.38 | 1.31 | 1.45 | 1.18 | 1.44 | 1.81 | 1.59 | 1.47 |
| SQM-030 | 0.55 | 0.87 | 0.7 | 1.26 | 1.01 | 1.03 | 1.07 | 1.12 | 1.12 | 1.03 | 1.17 | 1.84 | 1.83 | 2.11 |

EXAMPLE 5

AprL Variants with Improved Stability

The AprL variants described in Table 3 were tested in the stability assays described in Example 1 in the following detergents and buffer: LAS-EDTA buffer at 53.5° C., 10% Kirkland Ultra HDL pH 8.2 at 56° C., and OMO Klein &Krachtig HDL pH 8.2 at 51M. The Table 3 AprL variants with (i) stability PI>1.1 versus AprL Parent in at least one of the stability assays described in Example 1, and (ii) cleaning PI>1.01 in both the Laundry and ADW cleaning perfor-

EXAMPLE 6

Performance Evaluation of Additional AprL Variants

The AprL variants described in Table 3 were tested in the protease activity assay (AAPF or DMC assay) described in Example 1, laundry cleaning performance assay described in Example 1 using EMPA-116 BMI soil and All HDL and OMO Klein &Krachtig HDL detergents. ADW cleaning performance assay described in Example 1 using PAS-38 egg yolk soil and GSM-B pH10 and Finish® Quantum dish detergents, and the stability assays described in Example 1 in the following buffers: LAS-EDTA buffer at 53.5° C. and Tris-EDTA buffer at 51° C. The Table 3 AprL variants with a laundry cleaning PI>1.01 versus AprL parent are listed in Table 9. The Table 3 AprL variants with an ADW cleaning PI>1.01 versus AprL parent are listed in Table 10. The Table 3 AprL variants with a stability PI>1.01 versus AprL parent are listed in Table 11. The Table 3 AprL variants with laundry cleaning. ADW cleaning, and stability P>1.01 versus AprL parent in at least one detergent are listed in Table 12.

TABLE 9

AprL Variants Tested in HDL Detergents and BMI soil.

| Sample ID | ALL | OMO |
|---|---|---|
| SQM-005 | 1.59 | 1.35 |
| SQM-006 | 1.88 | 1.22 |
| SQM-009 | 1.78 | 1.02 |
| SQM-014 | 2.59 | 1.22 |
| SQM-015 | 2.04 | 1.31 |
| SQM-017 | 1.83 | 1.44 |
| SQM-018 | 2.65 | 1.47 |
| SQM-026 | 2.47 | 1.10 |
| SQM-031 | 1.44 | 1.35 |
| SQM-032 | 2.40 | 1.21 |
| SQM-034 | 1.45 | 1.03 |
| SQM-035 | 1.25 | 1.04 |
| SQM-036 | 1.38 | 1.04 |
| SQM-037 | 1.69 | 1.17 |
| SQM-038 | 1.00 | 1.17 |
| SQM-041 | 1.19 | 0.85 |
| SQM-042 | 1.40 | 0.86 |
| SQM-043 | 1.31 | 1.11 |
| SQM-044 | 1.05 | 0.91 |

TABLE 10

AprL Variants Tested in ADW Detergents and Egg soil.

| Sample ID | GSM-B pH 10 | Finish ® Quantum |
|---|---|---|
| SQM-005 | 2.16 | 1.57 |
| SQM-006 | 2.59 | 1.83 |
| SQM-009 | 1.78 | 1.38 |
| SQM-014 | 1.95 | 1.46 |
| SQM-015 | 1.75 | 1.39 |
| SQM-017 | 2.20 | 1.56 |
| SQM-018 | 2.10 | 1.51 |
| SQM-026 | 1.71 | 1.41 |
| SQM-031 | 2.14 | 1.38 |
| SQM-032 | 2.49 | 1.42 |
| SQM-034 | 2.07 | 1.35 |
| SQM-035 | 2.04 | 1.24 |
| SQM-036 | 1.60 | 1.17 |
| SQM-037 | 1.87 | 1.30 |
| SQM-038 | 1.85 | 1.47 |
| SQM-039 | 2.09 | 1.41 |
| SQM-040 | 1.82 | 1.21 |
| SQM-041 | 1.90 | 1.29 |
| SQM-042 | 2.03 | 1.25 |
| SQM-043 | 2.24 | 1.47 |
| SQM-044 | 1.98 | 1.26 |

TABLE 11

AprL Variants Tested in Stability Assays.

| Sample | LAS/EDTA | Tris/EDTA |
|---|---|---|
| SQM-005 | 1.94 | 1.68 |
| SQM-006 | 1.52 | 1.34 |
| SQM-009 | 1.84 | 1.66 |
| SQM-014 | 1.99 | 1.81 |
| SQM-015 | 1.97 | 1.24 |
| SQM-017 | 2.07 | 2.14 |
| SQM-018 | 1.83 | 2.02 |
| SQM-026 | 1.61 | 1.24 |
| SQM-031 | 1.89 | 1.87 |
| SQM-032 | 2.05 | 1.72 |
| SQM-034 | 2.60 | 1.78 |
| SQM-035 | 2.68 | 1.95 |
| SQM-036 | 2.72 | 2.20 |
| SQM-037 | 2.49 | 1.82 |
| SQM-038 | 0.31 | 1.14 |
| SQM-039 | 3.10 | 2.18 |
| SQM-040 | 2.57 | 1.76 |
| SQM-041 | 2.98 | 1.88 |
| SQM-042 | 2.46 | 0.71 |
| SQM-043 | 2.78 | 1.98 |
| SQM-044 | 2.78 | 1.96 |

TABLE 12

AprL Variants Tested in Cleaning Performance and Stability Assays.

| Sample ID | HDL, BMI | | ADW, EGG | | Stability | |
|---|---|---|---|---|---|---|
| | All | OMO | GSMB pH 10 | Finish ® Quantum | LAS/EDTA | Tris/EDTA |
| SQM-005 | 1.59 | 1.35 | 2.16 | 1.57 | 1.94 | 1.68 |
| SQM-006 | 1.88 | 1.22 | 2.59 | 1.83 | 1.52 | 1.34 |
| SQM-009 | 1.78 | 1.02 | 1.78 | 1.38 | 1.84 | 1.66 |
| SQM-014 | 2.59 | 1.22 | 1.95 | 1.46 | 1.99 | 1.81 |
| SQM-015 | 2.04 | 1.31 | 1.75 | 1.39 | 1.97 | 1.24 |
| SQM-017 | 1.83 | 1.44 | 2.20 | 1.56 | 2.07 | 2.14 |
| SQM-018 | 2.65 | 1.47 | 2.10 | 1.51 | 1.83 | 2.02 |
| SQM-026 | 2.47 | 1.10 | 1.71 | 1.41 | 1.61 | 1.24 |
| SQM-031 | 1.44 | 1.35 | 2.14 | 1.38 | 1.89 | 1.87 |
| SQM-032 | 2.40 | 1.21 | 2.49 | 1.42 | 2.05 | 1.72 |
| SQM-034 | 1.45 | 1.03 | 2.07 | 1.35 | 2.60 | 1.78 |
| SQM-035 | 1.25 | 1.04 | 2.04 | 1.24 | 2.68 | 1.95 |
| SQM-036 | 1.38 | 1.04 | 1.60 | 1.17 | 2.72 | 2.20 |
| SQM-037 | 1.69 | 1.17 | 1.87 | 1.30 | 2.49 | 1.82 |
| SQM-038 | 1.00 | 1.17 | 1.85 | 1.47 | 0.31 | 1.14 |
| SQM-041 | 1.19 | 0.85 | 1.90 | 1.29 | 2.98 | 1.88 |
| SQM-042 | 1.40 | 0.86 | 2.03 | 1.25 | 2.46 | 0.71 |
| SQM-043 | 1.31 | 1.11 | 2.24 | 1.47 | 2.78 | 1.98 |
| SQM-044 | 1.05 | 0.91 | 1.98 | 1.26 | 2.78 | 1.96 |

EXAMPLE 7

Cleaning Performance of AprL Variants in Non-Boron Containing Detergents

The cleaning performance of purified AprL variants: M123I-Q136R, M123-Q136R-G165Q, V045R-Q136R-G165Q-S258E, V045R-M123I-Q136R-G165Q-S258E, and V045R-M123I-Q136R were tested in the following detergents that did not contain detectable amounts of boron or boron-containing compounds: All 3X, Purex® Dirt Lift, and Persil Non Bio. These AprL variants were tested in the laundry cleaning performance assays described in Example 1. Results are shown in Table 13 as PI calculated versus AprL Parent. The proteases were tested at a dosage of 2.5 ppm. The amount of boron present in the boron-free detergents of this Example was quantified by elemental analysis, and in all instances, only trace amounts (less than 5 mg) of boron per kg of detergent were detected.

TABLE 13

Cleaning Performance In Boron-free Laundry Detergents, Reported As PI vs AprL Parent

|         | Persil Non-Bio | ALL 3X | Purex ® Dirt Lift |
|---------|----------------|--------|-------------------|
| Parent  | 1.0            | 1.0    | 1.0               |
| SQM-002 | 1.1            | 1.8    | 3.0               |
| SQM-012 | 1.1            | 2.7    | 2.0               |
| SQM-007 | 1.0            | 1.4    | 2.0               |
| SQM-024 | 0.9            | 1.1    | 1.2               |
| SQM-030 | 1.1            | 1.8    | 2.2               |

EXAMPLE 8

Cleaning Performance and Detergent Stability of AprL and BliD02339 Protease Variants AprL Variants listed in Table 14 were generated as described in Example 2. The cleaning performance and stability of the Table 14 variants were tested in one or more cleaning performance and stability assay described in Example 1.

The laundry cleaning performance of the AprL variants listed in Table 14 was tested on EMPA-116 microswatches in Test HDL 1 and Persil Non-Bio detergents (Table 1.1, assay conditions 8 and 10). Enzyme stability was tested in 10% Test HDL detergent at 52.5° C. and/or 54° C. (Table 2, assay condition 5). Table 15 shows the results as PI values when compared to AprL Parent, wherein ND means not determined.

Table 17 lists the performance of the AprL Variants tested according to the laundry cleaning performance and stability assays described in Example 1: (i) cleaning performance on EMPA-116, CFT CS-38, and CFT-C10 microswatches in Persil Non-Bio, Test HDL 1 and Test HDL 2 detergents, and (ii) stability in 10% PNB at 63° C. for 15-20 min and/or 10% Test HDL 1 at 60° C. for 15-20 min. Cleaning performance results are reported as P1 values versus the SQCBV35 variant (SEQ ID NO:63), and stability results are reported as % remaining activity of sample after stress versus unstressed condition. ND means the value was not determined.

TABLE 14

AprL Protease Variants

| Sample ID | Sequence Substitutions Relative To AprL Parent | SEQ ID NO: |
|-----------|-----------------------------------------------|------------|
| SQCBV12   | T77N-N217S-L234W                              | 51         |
| SQCBV13   | T77N-N217S                                    | 52         |
| SQCBV14   | T77N-G126Q-G165Q-T210P-N217S-L234W-S258P      | 53         |
| SQCBV15   | T77N-G127F-G165Q-A202V-T210P-N217S-L234W-S258P| 54         |
| SQCBV18   | A1Q-T3V-V28A-I35A-A68S-T77N-S86H-T115F-N217S-N239S-S250G-S258P-Q274A | 55 |
| SQCBV19   | T77N-M123I-T210P-N239S-S250G-S258P            | 56         |
| SQCBV20   | V45I-A68S-T77N-M123I-L125N-G165Q-N217S-S258P  | 57         |
| SQCBV21   | A68S-V71A-T77N-L95A-G165Q-N184Q-T210P-S258P   | 58         |
| SQCBV23   | M123I-T210P-N217S-S258P                       | 59         |
| SQCBV32   | G127F-G165Q-N217S-S258P                       | 60         |
| SQCBV33   | T77N-G165Q-N217S-S258P                        | 61         |
| SQCBV34   | T77S-G165A-N184Q-T210P-N217S                  | 62         |
| SQCBV35   | A68S-T77N-A128P-G165Q-N184Q-N217S             | 63         |
| SQCBV36   | V71A-T77S-N184Q-S258P                         | 64         |
| SQCBV37   | T77N-M123I-G165Q-N184Q-N217S                  | 65         |
| SQCBV38   | V71A-L95A-A128S-T210P                         | 66         |
| SQCBV39   | V71A-M123I-A128S-T210P                        | 67         |
| SQCBV40   | V71A-M123I-A128S-G165E                        | 68         |
| SQCBV41   | T77S-A128P-N184Q-N217S-F260W                  | 69         |
| SQCBV42   | T77H-A128S-G165Q-T210P                        | 70         |
| SQCBV43   | T77D-S86R-S155E-G165A-N184Q                   | 71         |
| SQCBV44   | A068S-V071A-T077N-A128S-G165Q-T210P-N217S     | 72         |
| SQCBV45   | V28A-I35A-A68S-T77N-A128S-G165Q-N184Q-G203N-T210P | 73     |
| SQCBV46   | A128P-T210P                                   | 74         |
| SQCBV47   | T210P-S258P                                   | 75         |
| SQCBV49   | A128P-T210P-S259P                             | 76         |
| SQCBV50   | A128P-S187P-T210P                             | 77         |
| SQCBV52   | A128P-S187P-T210P-S258P                       | 78         |
| SQCBV66   | P9E-T77S-V87T-T210P-N239K                     | 79         |
| SQCBV70   | K15I-L95Q-M123I-G165S-T210P-N217S             | 80         |
| SQCBV72   | K15I-M123I-V146S-G165S-T210P-N239S            | 81         |
| SQCBV73   | K15I-N76K-M123I-V146S-G165S-T210P-N239S       | 82         |
| SQCBV74   | K15I-V146S-G165S-T210P-N239S                  | 83         |
| SQCBV75   | P9E-V146S-N184Q-G203E-T210P-P238R-N239S       | 84         |
| SQCBV78   | M123I-G165S-N217S                             | 85         |
| SQCBV85   | K15I-L95Q-S108K-G165S-G203E-T210P-N217S       | 86         |
| SQCBV87   | K15I-L95Q-S108K-G165S-G203E-T210P             | 87         |
| SQCBV88   | P9E-K15I-G165S-A193D-G203E-T210P              | 88         |
| SQCBV103  | T77N-M123I-G165Q-N217S                        | 89         |
| SQCBV104  | T77H-G165Q                                    | 90         |
| SQCBV105  | T77N-G165Q-N217S                              | 91         |
| SQCBV106  | A68S-V71A-T77N-G165Q-N217S                    | 92         |
| SQCBV107  | T77N-V87S-M123I-S155G-G165Q-N217S             | 93         |

TABLE 14-continued

AprL Protease Variants

| Sample ID | Sequence Substitutions Relative To AprL Parent | SEQ ID NO: |
|---|---|---|
| SQCBV108 | T77H-V87S-S155G-G165Q | 94 |
| SQCBV109 | T77N-V87S-S155G-G165Q-N217S | 95 |
| SQCBV111 | T77N-M123I-G165Q | 96 |
| SQCBV112 | T77N-G165Q | 97 |
| SQCBV113 | A68S-V71A-T77N-G165Q | 98 |
| SQCBV114 | T77N-V87S-M123I-S155G-G165Q | 99 |
| SQCBV119 | I35A-A68S-T77N-V87S-V147L-G165Q | 100 |
| SQCBV121 | A68S-T77N-V87S-V147L-S155E-G165Q | 101 |
| SQCBV125 | T77N-V87S-M123I-V147L-S155G-G165Q | 102 |
| SQCBV143 | A68S-T77N-M123I-G165Q-N184Q-N217S | 103 |
| SQCBV161 | T77N-M123I-A128P-G165Q-N184Q-N217S | 104 |
| SQCBV188 | A68S-V71A-T77N-S100N-A128P-G165Q-N184Q-T210P-N217S-N239T | 105 |
| SQCBV191 | T77N-A128P-G165Q-N184Q-N217S | 106 |
| SQCBV192 | A68S-A128P-G165Q-N184Q-N217S | 107 |
| SQCBV193 | A68S-T77N-G165Q-N184Q-N217S | 108 |
| SQCBV194 | A68S-T77N-A128P-N184Q-N217S | 109 |
| SQCBV195 | A68S-T77N-A128P-G165Q-N217S | 110 |
| SQCBV196 | A68S-T77N-A128P-G165Q-N184Q | 111 |
| SQCBV197 | M123I-G165Q-N184Q-N217S | 112 |
| SQCBV198 | T77N-G165Q-N184Q-N217S | 113 |
| SQCBV199 | T77N-M123I-N184Q-N217S | 114 |
| SQCBV200 | T77N-M123I-G165Q-N184Q | 115 |
| SQCBV201 | T3V-A68S-T77N-A128P-G165Q-N184Q-N217S | 116 |
| SQCBV202 | T3V-A68S-T77N-M123I-A128P-G165Q-N184Q-N217S | 117 |
| SQCBV203 | T3V-T77N-M123I-G165Q-N184Q-N217S | 118 |
| SQCBV204 | A68S-T77N-S108H-A128P-G165Q-N184Q-N217S | 119 |
| SQCBV205 | A68S-T77N-G99S-A128P-G165Q-N184Q-N217S | 120 |
| SQCBV206 | A68S-T77N-T114N-A128P-G165Q-N184Q-N217S | 121 |
| SQCBV207 | A68S-T77N-M123I-A128P-G165Q-N184Q-N217S | 122 |
| SQCBV208 | A68S-T77N-G127T-A128P-G165Q-N184Q-N217S | 123 |
| SQCBV209 | A68S-T77N-A128P-G165Q-N184Q-T210P-N217S | 124 |
| SQCBV211 | A68S-T77N-G99S-M123I-A128P-G165Q-N184Q-N217S | 125 |
| SQCBV212 | A68S-T77N-G99S-G127T-A128P-G165Q-N184Q-N217S | 126 |
| SQCBV213 | A68S-T77N-G99S-A128P-G165Q-N184Q-T210P-N217S | 127 |
| SQCBV214 | A68S-T77N-T114N-M123I-A128P-G165Q-N184Q-N217S | 128 |
| SQCBV215 | A68S-T77N-T114N-G127T-A128P-G165Q-N184Q-N217S | 129 |
| SQCBV216 | A68S-T77N-T114N-A128P-G165Q-N184Q-T210P-N217S | 130 |
| SQCBV217 | A68S-T77N-M123I-G127T-A128P-G165Q-N184Q-N217S | 131 |
| SQCBV218 | A68S-T77N-M123I-A128P-G165Q-N184Q-T210P-N217S | 132 |
| SQCBV219 | A68S-T77N-G127T-A128P-G165Q-N184Q-T210P-N217S | 133 |
| SQCBV221 | A68S-T77N-G99S-M123I-A128P-G165Q-N184Q-T210P-N217S | 134 |
| SQCBV223 | A68S-T77N-M123I-G127T-A128P-G165Q-N184Q-T210P-N217S | 135 |
| SQCBV225 | T3V-A68S-T77N-G99S-M123I-A128P-G165Q-N184Q-N217S | 136 |
| SQCBV226 | T3V-A68S-T77N-T114N-M123I-A128P-G165Q-N184Q-N217S | 137 |
| SQCBV227 | T3V-A68S-T77N-M123I-G127T-A128P-G165Q-N184Q-N217S | 138 |
| SQCBV228 | T3V-A68S-T77N-M123I-A128P-G165Q-N184Q-T210P-N217S | 139 |
| SQCBV269 | S86H-T115F-A143V-G165Q-A202V-S258P | 140 |
| SQCBV270 | S86H-L95A-N184Q-A202V-T210P-N217S-L234W-S250G-S258P | 141 |
| SQCBV271 | V30T-I35A-T77N-G165Q-A202V-T210P-S250G-S258P | 142 |
| SQCBV272 | A1Q-T3V-I35A-T77N-T78I-S86H-T115F-G165Q-N184Q-N217S-L234W-S258P | 143 |
| SQCBV273 | A1Q-A37T-T77N-T78I-S86H-M123I-G165Q-N184Q-A202V-N239S-S250G-S258P-Q274A | 144 |
| SQCBV274 | P9E-T77N-N96S-G165Q-G203E-S250G | 145 |
| SQCBV275 | P9E-T77N-N96S-G165E-G203E-T210P-S250G | 146 |
| SQCBV276 | A1Q-T3V-S86H-G130S-S155G-G165Q-N184Q-A202V-G203N-T210P-Q274A | 147 |
| SQCBV277 | A1Q-T3V-S86H-G165Q-N184Q-N239S-S250G-S258P | 148 |
| SQCBV278 | A1Q-T77N-S86H-V147L-A151G-N184Q-N217S-S258P | 149 |
| SQCBV279 | S86H-T115F-S155G-G165Q-N184Q-A202V-Q274A | 150 |
| SQCBV280 | A68S-S86H-T115F-N184Q-A202V-G203N-N239S-S250G-S258P-Q274A | 151 |

TABLE 15

Cleaning And Stability Of AprL Variants Compared To AprL Parent, Reported as PI

| Sample ID | Cleaning Performance EMPA 116 Swatches | | Stability 10% Test HDL | |
| --- | --- | --- | --- | --- |
| | Test HDL1 | Persil Non-bio | 55° C. | 52.5° C. |
| AprL WT | 1.0 | 1.0 | 1.0 | 1.0 |
| SQCBV12 | 0.8 | ND | ND | 1.1 |
| SQCBV13 | 1.0 | ND | ND | 1.6 |
| SQCBV14 | 0.6 | ND | ND | 1.1 |
| SQCBV15 | 0.8 | ND | ND | 1.1 |
| SQCBV18 | 0.7 | ND | ND | 1.2 |
| SQCBV19 | 1.2 | ND | ND | 1.2 |
| SQCBV20 | 1.1 | ND | ND | 1.1 |
| SQCBV21 | 1.0 | ND | ND | 1.1 |
| SQCBV23 | 1.1 | ND | ND | 1.4 |
| SQCBV32 | 1.1 | ND | ND | 1.2 |
| SQCBV33 | 1.0 | ND | ND | 1.3 |
| SQCBV34 | 0.7 | ND | ND | 1.1 |
| SQCBV35 | 0.9 | ND | ND | 1.4 |
| SQCBV36 | 0.9 | ND | ND | 1.4 |
| SQCBV37 | 0.9 | ND | ND | 1.5 |
| SQCBV38 | 1.2 | ND | ND | 1.2 |
| SQCBV39 | 1.2 | ND | ND | 1.4 |
| SQCBV40 | 1.1 | ND | ND | 1.4 |
| SQCBV41 | 1.0 | ND | ND | 1.4 |
| SQCBV42 | 1.0 | ND | ND | 1.5 |
| SQCBV43 | 1.0 | ND | ND | 1.7 |
| SQCBV44 | 0.9 | ND | ND | 1.7 |
| SQCBV45 | 0.9 | ND | ND | 1.7 |
| SQCBV46 | 0.9 | ND | ND | 1.1 |
| SQCBV47 | 1.0 | ND | ND | 1.4 |
| SQCBV49 | 1.0 | ND | ND | 1.3 |
| SQCBV50 | 0.9 | ND | ND | 1.6 |
| SQCBV52 | 1.0 | ND | ND | 1.7 |
| SQCBV66 | 0.8 | ND | ND | 1.3 |
| SQCBV70 | 0.7 | ND | ND | 1.9 |
| SQCBV72 | 1.0 | ND | ND | 1.5 |
| SQCBV73 | 0.8 | ND | ND | 1.4 |
| SQCBV74 | 0.8 | ND | ND | 1.4 |
| SQCBV75 | 0.8 | ND | ND | 2.0 |
| SQCBV78 | 1.0 | ND | ND | 1.9 |
| SQCBV85 | 0.8 | ND | ND | 1.3 |
| SQCBV87 | 0.7 | ND | ND | 1.1 |
| SQCBV88 | 0.6 | ND | ND | 1.7 |
| SQCBV269 | 0.9 | 0.87 | 7.64 | ND |
| SQCBV270 | 0.9 | 0.87 | 7.65 | ND |
| SQCBV271 | 0.8 | 0.84 | 7.28 | ND |
| SQCBV272 | 0.9 | 0.86 | 8.06 | ND |
| SQCBV273 | 0.9 | 0.88 | 7.7 | ND |
| SQCBV274 | 0.8 | 0.85 | 7.37 | ND |
| SQCBV275 | 0.9 | 0.88 | 7.82 | ND |
| SQCBV276 | 0.7 | 0.7 | 7.85 | ND |
| SQCBV277 | 0.9 | 0.93 | 6.99 | ND |
| SQCBV278 | 0.9 | 0.83 | 7.5 | ND |
| SQCBV279 | 0.7 | 0.71 | 7.83 | ND |
| SQCBV280 | 0.7 | 0.73 | 7.46 | ND |

TABLE 16A

Aged Cleaning Performance Of AprL Variants Compared To AprL Parent, Reported As % Remaining Cleaning Activity

| Sample ID | % Remaining Cleaning Activity After 24 h |
| --- | --- |
| AprL WT | 0 |
| SQCBV13 | 94 |
| SQCBV14 | 98 |
| SQCBV19 | 89 |
| SQCBV20 | 110 |
| SQCBV21 | 99 |
| SQCBV23 | 72 |
| SQCBV32 | 72 |
| SQCBV33 | 84 |
| SQCBV35 | 110 |
| SQCBV36 | 75 |
| SQCBV37 | 110 |
| SQCBV38 | 55 |
| SQCBV39 | 61 |
| SQCBV40 | 84 |
| SQCBV41 | 86 |
| SQCBV42 | 100 |
| SQCBV43 | 99 |
| SQCBV44 | 84 |
| SQCBV45 | 90 |
| SQCBV46 | 50 |
| SQCBV47 | 72 |
| SQCBV49 | 54 |
| SQCBV50 | 73 |
| SQCBV52 | 74 |
| SQCBV66 | 96 |
| SQCBV72 | 76 |
| SQCBV73 | 58 |
| SQCBV74 | 87 |
| SQCBV78 | 51 |

TABLE 16B

Aged Cleaning Performance Of AprL Variants Compared To AprL Parent, Reported As % Remaining Cleaning Activity

| Sample ID | % Remaining Cleaning Activity |
| --- | --- |
| Apr LWT | 6 |
| SQCBV269 | 91 |
| SQCBV270 | 87 |
| SQCBV277 | 58 |
| SQCBV276 | 60 |
| SQCBV273 | 71 |
| SQCBV275 | 61 |
| SQCBV272 | 78 |
| SQCBV271 | 84 |
| SQCBV279 | 54 |
| SQCBV280 | 53 |
| SQCBV278 | 57 |
| SQCBV274 | 63 |

TABLE 17

Cleaning Of AprL Variants Compared To SQCBV35 Variant, Reported As PI For Cleaning Assays And Stability As % Remaining Activity For Stability Assays

|  | Microswatch Cleaning | | | | | | | | | Stability | |
|---|---|---|---|---|---|---|---|---|---|---|---|
|  | Persil-Non Bio | | | Test HDL 2 | | | Test HDL 1 | | | | |
| Sample ID | EMPA-116 | CFT-CS-38 | CFT-C10 | EMPA-116 | CFT-CS-38 | CFT-C10 | EMPA-116 | CFT-CS-38 | CFT-C10 | 10% PNB 63° C. | Test HDL 1 60° C. |
| Apr LWT | 1.27 | 1.33 | 1.43 | 1.81 | 1.51 | 1.23 | 1.33 | 1.45 | 1.49 | 0.1 | 0.1 |
| SQCBV35 | 1.00 | 1.00 | 1.00 | 1.00 | 1.00 | 1.00 | 1.00 | 1.00 | 1.00 | 15.4 | 40.7 |
| SQCBV103 | 1.12 | 0.90 | 1.17 | 1.64 | 1.38 | 1.16 | 1.15 | 1.26 | 1.17 | 0.2 | 1.7 |
| SQCBV104 | 1.17 | 1.14 | 1.19 | 1.64 | 1.71 | 1.20 | ND | ND | ND | 0.2 | ND |
| SQCBV105 | 1.06 | 0.92 | 1.26 | 1.62 | 1.67 | 1.13 | ND | ND | ND | 0.8 | ND |
| SQCBV106 | 1.01 | 0.66 | 0.93 | 1.33 | 1.19 | 0.89 | ND | ND | ND | 2.9 | ND |
| SQCBV107 | 1.16 | 0.92 | 0.99 | 1.56 | 1.56 | 1.02 | ND | ND | ND | 7.1 | ND |
| SQCBV108 | 0.97 | 0.67 | 1.06 | 0.91 | 1.10 | 0.95 | ND | ND | ND | 0.5 | ND |
| SQCBV109 | 0.92 | 0.55 | 1.01 | 1.01 | 1.07 | 0.96 | ND | ND | ND | 0.4 | ND |
| SQCBV111 | 1.25 | 1.21 | 1.09 | 2.50 | 2.13 | 1.32 | ND | ND | ND | 0.7 | ND |
| SQCBV112 | 1.26 | 1.03 | 1.34 | 1.66 | 1.54 | 1.12 | ND | ND | ND | 0.2 | ND |
| SQCBV113 | 1.12 | 1.02 | 1.15 | 1.52 | 1.43 | 1.16 | ND | ND | ND | 0.2 | ND |
| SQCBV114 | 1.16 | 1.11 | 0.95 | 1.68 | 1.52 | 1.06 | ND | ND | ND | 0.8 | ND |
| SQCBV119 | 1.20 | 1.32 | 1.40 | 1.48 | 1.66 | 1.41 | ND | ND | ND | 1.0 | ND |
| SQCBV121 | 1.22 | 1.13 | 1.24 | 1.36 | 1.28 | 1.12 | ND | ND | ND | 4.8 | ND |
| SQCBV125 | 1.15 | 0.85 | 0.96 | 1.44 | 1.34 | 0.93 | ND | ND | ND | 1.9 | ND |
| SQCBV143 | 1.11 | 0.94 | 0.93 | 1.41 | 1.54 | 0.79 | ND | ND | ND | 3.7 | ND |
| SQCBV161 | 1.02 | 0.94 | 0.76 | 1.46 | 1.02 | 0.82 | ND | ND | ND | 9.6 | ND |
| SQCBV188 | 0.98 | 0.70 | 0.89 | 1.05 | 1.03 | 0.82 | ND | ND | ND | 16.0 | ND |
| SQCBV191 | 0.99 | 1.13 | 1.09 | 1.12 | 0.93 | 1.05 | 1.05 | 1.31 | 1.03 | 10.2 | 34.0 |
| SQCBV192 | 0.94 | 1.01 | 0.98 | 0.99 | 0.88 | 0.94 | 0.98 | 1.00 | 0.91 | 5.6 | 27.6 |
| SQCBV193 | 0.96 | 1.06 | 1.02 | 1.03 | 0.98 | 1.03 | 1.04 | 1.08 | 0.97 | 5.6 | 21.0 |
| SQCBV194 | 1.04 | 1.18 | 1.03 | 1.16 | 1.03 | 1.01 | 1.01 | 1.18 | 0.92 | 0.2 | 3.7 |
| SQCBV195 | 0.92 | 0.92 | 0.94 | 1.01 | 0.82 | 0.97 | 0.92 | 0.90 | 0.84 | 10.0 | 31.6 |
| SQCBV196 | 0.98 | 0.92 | 0.90 | 1.07 | 1.01 | 1.00 | 0.99 | 1.12 | 0.81 | 3.4 | 19.3 |
| SQCBV197 | 1.14 | 1.42 | 1.18 | 1.58 | 1.33 | 1.11 | 1.21 | 1.60 | 1.13 | 0.1 | 2.0 |
| SQCBV198 | 0.99 | 1.08 | 1.05 | 1.09 | 1.16 | 1.07 | 1.00 | 1.27 | 1.01 | 1.9 | 11.3 |
| SQCBV199 | 1.42 | 1.56 | 1.70 | 2.18 | 2.66 | 1.46 | 1.42 | 1.89 | 1.66 | 0.0 | 0.4 |
| SQCBV200 | 1.21 | 1.50 | 1.21 | 1.65 | 1.36 | 1.22 | 1.26 | 1.70 | 1.21 | 0.0 | 0.6 |
| SQCBV201 | 0.90 | 0.95 | 1.07 | 0.99 | 0.91 | 0.97 | 0.96 | 0.92 | 0.84 | 32.2 | 55.9 |
| SQCBV202 | 1.05 | 1.12 | 0.98 | 1.29 | 1.15 | 1.08 | 1.08 | 1.14 | 0.96 | 16.5 | 42.0 |
| SQCBV203 | 1.20 | 1.31 | 1.23 | 1.62 | 1.34 | 1.20 | 1.18 | 1.42 | 1.11 | 1.9 | 10.1 |
| SQCBV204 | 0.87 | 0.77 | 0.81 | 0.96 | 0.78 | 0.94 | 0.90 | 0.90 | 0.72 | 17.0 | 42.8 |
| SQCBV205 | 1.17 | 1.12 | 1.00 | 1.44 | 1.11 | 1.07 | 1.29 | 1.44 | 0.94 | 8.3 | 27.8 |
| SQCBV206 | 0.88 | 0.87 | 0.89 | 0.86 | 0.73 | 0.95 | 0.91 | 1.05 | 0.89 | 15.4 | 41.2 |
| SQCBV207 | 1.06 | 1.23 | 1.13 | 1.26 | 1.31 | 1.08 | 1.15 | 1.40 | 1.10 | 5.0 | 24.6 |
| SQCBV208 | 1.17 | 1.28 | 1.33 | 1.46 | 1.24 | 1.20 | 1.24 | 1.41 | 1.25 | 9.6 | 36.7 |
| SQCBV209 | 0.99 | 1.04 | 0.97 | 1.11 | 0.88 | 1.02 | 1.02 | 0.91 | 0.99 | 16.8 | 43.2 |
| SQCBV211 | 1.38 | 1.06 | 0.92 | 1.72 | 1.23 | 1.08 | 1.37 | 1.28 | 0.82 | 4.0 | 19.6 |
| SQCBV212 | 1.32 | 0.42 | 0.72 | 1.66 | 1.02 | 0.86 | 1.31 | 0.75 | 0.61 | 3.7 | 22.6 |
| SQCBV213 | 1.19 | 1.13 | 1.04 | 1.48 | 1.20 | 1.10 | 1.25 | 1.37 | 1.01 | 10.6 | 34.2 |
| SQCBV214 | 0.99 | 0.97 | 1.00 | 1.16 | 0.93 | 0.99 | 1.06 | 1.18 | 0.95 | 4.2 | 22.5 |
| SQCBV215 | 1.12 | 0.96 | 1.37 | 1.57 | 1.43 | 1.21 | 1.19 | 1.09 | 1.35 | 5.2 | 31.9 |
| SQCBV216 | 1.01 | 0.97 | 1.00 | 1.00 | 0.98 | 1.00 | 1.08 | 1.04 | 1.04 | 14.2 | 41.9 |
| SQCBV217 | 1.18 | 1.05 | 1.03 | 1.51 | 0.94 | 1.07 | 1.24 | 1.08 | 0.98 | 2.7 | 20.3 |
| SQCBV218 | 1.06 | 1.15 | 1.05 | 1.40 | 1.18 | 1.14 | 1.11 | 1.12 | 1.02 | 6.3 | 29.5 |
| SQCBV219 | 1.17 | 1.12 | 1.25 | 1.46 | 1.29 | 1.29 | 1.18 | 1.30 | 1.28 | 8.9 | 36.8 |
| SQCBV221 | 1.32 | 0.97 | 0.86 | 1.72 | 0.99 | 1.01 | 1.43 | 1.31 | 0.88 | 6.3 | 29.2 |
| SQCBV223 | 1.13 | 0.82 | 1.07 | 1.46 | 1.36 | 1.12 | 1.20 | 1.05 | 0.99 | 2.3 | 21.4 |
| SQCBV225 | 1.30 | 1.11 | 0.94 | 1.70 | 0.97 | 1.08 | 1.41 | 1.29 | 0.99 | 11.5 | 34.7 |
| SQCBV226 | 1.02 | 0.82 | 0.97 | 1.11 | 1.07 | 1.04 | 1.03 | 0.86 | 0.93 | 13.5 | 38.6 |
| SQCBV227 | 1.17 | 0.88 | 1.08 | 1.51 | 1.24 | 1.08 | 1.21 | 1.13 | 1.02 | 13.6 | 39.4 |
| SQCBV228 | 1.03 | 0.77 | 1.10 | 1.38 | 1.21 | 1.04 | 1.07 | 1.10 | 1.01 | 17.1 | 44.0 |

Variants of BliD02339 Parent protease (SEQ ID NO:9) (hereinafter "BliD Variants") set forth in Table 18 were generated as described in Example 2 and tested as described in Example 1 for cleaning performance and stability.

Table 18 lists BliD Variants that show improvement over BliD Parent in cleaning performance on technical soil microswatches: EMPA-116, CFT CS-38, and CFT-C10, when tested in Persil Non-Bio, and Test HDL 2 laundry detergents, and also showed improved stability when tested in 10% Persil Non-Bio (PNB) laundry detergent (stressed at 63° C. for 15-20m). The cleaning performance and stability results are reported in Table 19. Cleaning performance results are reported as PI values versus the BliD Parent (SEQ ID NO: 9), and stability results are reported as % remaining activity of sample after stress versus unstressed condition. ND means the value was not determined.

TABLE 18

List of BliD02339 Protease Variants

| Sample ID | Mutations With Respect To BliD02339 Parent | Mutations With Respect To AprL Parent | SEQ ID NO: |
|---|---|---|---|
| SQBLV126 | A068S-T077N-N086S-G165Q-K194E-S211N-N217S | A068S-T077N-A128P-G165Q-N217S | 152 |
| SQBLV127 | A068S-T077N-N086S-V087S-S155G-G165Q-K194E-S211N-N217S | A068S-T077N-V087S-A128P-S155G-G165Q-N217S | 153 |
| SQBLV128 | A068S-T077N-N086S-G165Q-K194E-S211N | A068S-T077N-A128P-G165Q | 154 |
| SQBLV129 | A068S-T077N-N086S-V087S-S155G-G165Q-K194E-S211N | A068S-T077N-V087S-A128P-S155G-G165Q | 155 |
| SQBLV130 | I035A-A068S-T077N-N086S-V087S-V147L-G165Q-K194E-S211N-N217S | I035A-A068S-T077N-V087S-A128P-V147L-G165Q-N217S | 156 |
| SQBLV131 | A068S-T077N-N086S-V087S-S155G-G165Q-K194E-S211N-N217S-A242G | A068S-T077N-V087S-A128P-S155G-G165Q-N217S-A242G | 157 |
| SQBLV132 | A068S-T077N-N086S-V087S-V147L-S155E-G165Q-K194E-S211N | A068S-T077N-V087S-A128P-V147L-S155E-G165Q | 158 |
| SQBLV133 | A068S-T077N-N086S-V087S-S155E-G165Q-K194E-S211N-N217S | A068S-T077N-V087S-A128P-S155E-G165Q-N217S | 159 |
| SQBLV134 | A068S-T077N-V087S-S155G-G165Q-K194E-S211N-N217S-A242G | A068S-T077N-S086N-V087S-A128P-S155G-G165Q-N217S-A242G | 160 |
| SQBLV135 | I035A-A068S-T077N-N086S-V147L-G165Q-K194E-S211N-N217S | I035A-A068S-T077N-A128P-V147L-G165Q-N217S | 161 |
| SQBLV136 | I035A-A068S-T077N-N086S-S155G-G165Q-K194E-S211N-A242G | I035A-A068S-T077N-A128P-S155G-G165Q-A242G | 162 |
| SQBLV137 | 0I35A-A068S-T077N-N086S-V147L-G165Q-K194E-S211N-A242G | I035A-A068S-T077N-A128P-V147L-G165Q-A242G | 163 |
| SQBLV138 | A068S-T077N-N086S-V087S-S155G-G165Q-K194E-S211N-A242G | A068S-T077N-V087S-A128P-S155G-G165Q-A242G | 164 |

TABLE 19

Comparison of Cleaning of BliD Variants to BliD Parent, Reported As PI For Cleaning Assays And Stability As % Remaining Activity For Stability Assays

| | Persil-Non Bio | | | Test HDL 2 | | | Stability in 10% PNB |
|---|---|---|---|---|---|---|---|
| Sample ID | EMPA-116 | CFT-CS-38 | CFT-C10 | EMPA-116 | CFT-CS-38 | CFT-C10 | 63° C. |
| BliD Parent | 1.0 | 1.0 | 1.0 | 1.0 | 1.0 | 1.0 | 0.7 |
| SQBLV126 | 1.7 | 2.1 | 2.7 | 1.2 | 1.4 | 3.0 | 10.3 |
| SQBLV127 | 1.3 | 0.9 | 1.8 | 0.6 | 0.8 | 2.2 | 45.8 |
| SQBLV128 | 1.6 | 2.3 | 2.4 | 1.3 | 1.3 | 2.8 | 1.7 |
| SQBLV129 | 1.2 | 1.4 | 1.7 | 0.8 | 0.9 | 2.0 | 18.3 |
| SQBLV130 | 1.4 | 1.7 | 1.7 | 1.1 | 0.9 | 1.8 | 37.8 |
| SQBLV131 | 1.1 | 0.6 | 1.3 | 0.4 | 0.6 | 1.6 | 55.9 |
| SQBLV132 | 1.5 | 1.6 | 1.8 | 1.2 | 0.9 | 2.1 | 24.2 |
| SQBLV133 | 1.4 | 1.7 | 1.8 | 1.1 | 0.9 | 2.0 | 41.2 |
| SQBLV134 | 1.3 | 2.1 | 2.2 | 0.6 | 0.9 | 2.3 | 48.8 |
| SQBLV135 | 1.6 | 1.7 | 2.4 | 1.1 | 1.1 | 2.7 | 15.5 |
| SQBLV136 | 1.2 | 1.1 | 2.0 | 0.7 | 0.9 | 2.1 | 13.8 |
| SQBLV137 | 1.5 | 2.1 | 1.9 | 1.4 | 1.1 | 2.3 | 3.4 |
| SQBLV138 | 1.4 | 2.1 | 2.1 | 0.7 | 0.9 | 2.2 | 29.7 |

Comparison of AprL Protease to Related Molecules

Identification of Homologous Proteases

Proteins related to the AprL protease (SEQ ID NO:2) were identified by a BLAST search (Altschul et al., Nucleic Acids Res, 25:3389-402, 1997) against the NCBI non-redundant protein database and a subset are shown in Table 20. A similar search was run against the Genome Quest Patent database with search parameters set to default values and a subset are shown in Table 21. The mature amino acid sequence (274 amino acids) for AprL protease (SEQ ID NO:2) was used as the query sequence for both searches. Percent identity (PID) for both search sets is defined as the number of identical residues divided by the number of aligned residues in the pairwise alignment. The column labeled "Sequence Length" corresponds to the length (in amino acids) of the proteins identified by accession number in the column labeled "Accession No.," while "Alignment Length" refers to the length (in amino acids) of the sequence used for alignment and PID calculation.

TABLE 20

List of Sequences With % Identity to AprL Protein
Identified In NCBI Non-redundant Protein Database

| Accession No. | PID | Organism | Sequence Length | Alignment Length |
|---|---|---|---|---|
| CAJ70731.1 | 100 | B. licheniformis | 379 | 274 |
| AEQ38580 | 99.6 | B. licheniformis | 370 | 275 |
| AAG10033/AF283295 | 99.6 | B. licheniformis | 310 | 274 |
| AKI30031 | 99.6 | B. licheniformis | 379 | 274 |
| WP_020450819 | 99.6 | Bacillus paralicheniformis | 379 | 274 |
| AID16241 | 99.3 | B. licheniformis | 379 | 274 |
| AAG00493 | 98.9 | B. licheniformis | 310 | 274 |
| AEU17777 | 98.9 | B. licheniformis | 349 | 274 |
| ADK11044 | 98.5 | B. licheniformis | 379 | 274 |
| OJT55573 | 98.5 | Bacillus licheniformis | 378 | 274 |
| EWH21773 | 98.2 | B. licheniformis S 16 | 378 | 274 |
| WP_082247249 | 98.2 | Bacillus | 379 | 274 |
| YP_006712489/ WP_011197728.1 | 98 | B. licheniformis DSM13 | 379 | 274 |
| AEU12640 | 97 | B. licheniformis | 379 | 274 |
| CAA62667 | 95 | B. licheniformis | 379 | 273 |
| CAA62666 | 95.6 | B. licheniformis | 379 | 273 |
| WP_026586291 | 89.1 | Bacillus sp. NSP9.1 | 379 | 275 |
| WP_077737098 | 89.1 | Bacillus sonorensis | 379 | 275 |
| WP_076761713 | 88.4 | Bacillus sp. NRRL B-41294 | 379 | 276 |
| P00781 | 88 | B. licheniformis (subtilisin DY) | 274 | 274 |
| WP_006636716 | 87 | B. sonorensis | 378 | 274 |
| WP_082634659 | 85.4 | Bacillus glycinifermentans | 359 | 274 |
| WP_007497196 | 73 | B. stratosphericus | 383 | 274 |
| ADK11996 | 72 | B. pumilus | 383 | 274 |
| ADN04910 | 72 | B. circulans | 275 | 274 |
| AFP23380 | 72 | B. lehensis | 276 | 274 |
| WP_017360299 | 72 | B. cereus | 383 | 274 |
| YP_003972439/ WP_003327717.1 | 72 | B. atrophaeus 1942 | 382 | 275 |
| BAN09118 | 71 | B. subtilis | 381 | 274 |
| WP_010192405 | 71 | Bacillus sp. m3-13 | 379 | 276 |
| WP_010333625 | 71 | B. mojavensis | 381 | 274 |
| AAC43580 | 70 | Bacillus sp. SprC | 378 | 274 |
| ACJ07037 | 70 | B. subtilis | 381 | 274 |
| WP_010329279 | 70 | B. vallismortis | 381 | 274 |
| BAD11988 | 69 | Bacillus sp. KSM-LD1 | 376 | 274 |
| BAD21128 | 69 | Bacillus sp. KSM-LD1 | 377 | 276 |
| AAC43581 | 69 | Bacillus sp. SprD | 379 | 276 |
| CAA74536 | 69 | B. subtilis str. 168 | 379 | 275 |
| CAA24990 | 69 | B. amyloliquefaciens | 376 | 275 |
| AGC81872/ WP_032874368 | 69 | B. velezensis | 382 | 275 |
| ABY25856 | 68 | Geobacillus stearothermophilus | 382 | 275 |
| ADC49870/ WP_012957236 | 62 | B pseudofirmus | 374 | 274 |
| AAA22212 | 60 | B alcalophilus | 380 | 274 |
| WP_062748019 | 60 | B clausii | 380 | 274 |
| P29600 | 60 | B. lentus | 269 | 274 |
| BAA25184 | 58 | Bacillus sp AprN | 379 | 273 |
| AFK08970 | 58 | B. lehensis | 378 | 273 |
| AAA87324/P20724 | 58 | B. subtilis | 378 | 273 |
| ADD64465 | 55 | Bacillus sp. JB99 | 361 | 274 |
| AGS78407 | 55 | Bacillus gibsonii | 375 | 273 |
| BAA06157.1/ WP_003321226 | 54.9 | Prepro-subtilisin Sendai, Bacillus sp. G-825-6 | 382 | 273 |
| BAB04574.1/ WP_010897028 | 54.7 | B. halodurans C-125 | 361 | 274 |
| ABI26631 | 54 | B. clausii | 361 | 274 |
| BAA05540/ WP_053432556 | 54 | Bacillus sp. | 361 | 274 |

TABLE 21

List Of Sequences With % Identity To AprL Protein
Identified In Genome Quest Patent Database

| Patent/Patent Appl Pub No-SEQ ID NO | PID Organism | Sequence Length | Alignment Length |
|---|---|---|---|
| WO2014013080-0002 | 100.0 *B. lichemformis* | 274 | 274 |
| CN101215534-0002 | 99.6 *B. licheniformis* YP1A | 379 | 274 |
| WO2017006266-0002 | 99.6 *Bacillus licheniformis* Synthetic | 379 | 274 |
| WO9739130-0002 | 99.6 *B. licheniformis*; strain PWD-1 | 379 | 274 |
| US8110391-0009 | 99.3 *B. lichemformis* | 274 | 274 |
| JP2013500714-0110 | 98.9 *B. lichemformis* | 274 | 274 |
| WO2006122655-0031 | 98.5 *B. lichemformis* | 379 | 274 |
| US7087415-0014 | 98.2 *B. lichemformis* | 379 | 274 |
| US20110171718-0120 | 97.8 *B. licheniformis* | 274 | 273 |
| US20030049619-0014 | 97.4 *B. licheniformis* | 378 | 273 |
| JP2013500714-0121 | 96.0 *B. licheniformis* | 274 | 273 |
| US7569226-0012 | 88.3 *B. subtilis* DY | 274 | 274 |
| US20050009167-0017 | 88.0 *B. subtilis* DY | 274 | 274 |
| US20110171718-0098 | 88.3 *B. licheniformis* | 274 | 274 |
| W02008066931-6106 | 83.6 *B. licheniformis*; SJ1904 (ATCC PTA-7992) | 333 | 274 |
| JP2013500714-0106 | 73.0 *B. pumilus* | 275 | 274 |
| JP2004313043-0002 | 72.7 *Bacillus* sp. KSM-9865 | 275 | 275 |
| JP2004313043-0001 | 72.7 *Bacillus* sp. KSM-KP43 | 275 | 275 |
| JP2013500714-0096 | 70.5 *B. pumilus* | 275 | 274 |
| WO2011014278-0084 | 70.6 *B. subtilis* | 275 | 275 |

Alignment of Subtilisin Sequences with Apr.

The amino acid sequences of mature AprL (SEQ ID NO: 2) and BliD02339 (SEQ ID NO:9) proteins were aligned with the mature sequences of multiple subtilisins in Tables 20 and 21 using CLUSTALW software (Thompson et al., Nucleic Acids Research, 22:4673-4680, 1994) with the default parameters. This alignment is set forth in FIG. 1 with a box drawn around one or more amino acid motifs selected from SEQ ID NOs: 166, 167, 168, 169, 170, 171, 172, 173, 174, 175, 176, 177, 178, and 179.

EXAMPLE 10

Phylogenetic Tree for Subtilisins Including AprL and BliD02339

A phylogenetic tree for the mature sequences of AprL protein (SEQ ID NO:2), BliD02339 protein (SEQ ID NO:9), AprL protease variants: SQM-30 (SEQ ID NO: 36), SQCBV 20 (SEQ ID NO: 57), SQCBV35 (SEQ ID NO:63), SQCBV37 (SEQ ID NO:65), SQCBV188 (SEQ ID NO:105), SQCBV269 (SEQ ID NO:140), SQBLV 134 (SEQ ID NO:160), SQCBV328 (SEQ ID NO:268), SQCBV419 (SEQ ID NO:302), SQCBV555 (SEQ ID NO:358), SQCBV567 (SEQ ID NO:370), and SQCBV582 (SEQ ID NO:384) was built using a subset of the sequences of subtilisins shown in Tables 20 and 21. The sequences were entered in the Vector NTI Advance suite and a Guide Tree was created using the Neighbor Joining method (NJ) (Saitou, N.; and Nei, M. (1987) Mol Biol Evol 4, 406-425). The NJ method works on a matrix of distances between all pairs of sequences to be analyzed. These distances are related to the degree of divergence between the sequences. The Guide Tree is calculated after the sequences are aligned. The tree construction was calculated using the following parameters: Kimura's correction for sequence distance and ignoring positions with gaps. The MEGA 6 program was used to display the phylogenetic tree shown in FIG. 2. Based on the phylogenetic tree distribution, certain subtilisins have been grouped as shown in FIG. 2 to form the AprL-clade.

EXAMPLE 11

Additional AprL Variants

AprL variants listed on Table 22 were generated as described in Example 2.

TABLE 22

Additional AprL Protease Variants

| Sample ID | Sequence Substitutions Relative To AprL Parent | SEQ ID NO: |
|---|---|---|
| SQCBV229 | A68S-T77N-G127T-A128P-G165Q-N184Q-A202V-N217S | 191 |
| SQCBV230 | T3V-A68S-T77N-M123I-A128P-G165Q-N184Q-A202V-N217S | 193 |
| SQCBV231 | A68S-T77N-G127T-A128P-G165Q-N184Q-N217S-S258P | 206 |
| SQCBV232 | T3V-A68S-T77N-M123I-A128P-G165Q-N184Q-N217S-S258P | 207 |
| SQCBV233 | A68S-T77N-G127T-A128P-G165Q-N184Q-G203Q-N217S | 208 |
| SQCBV234 | T3V-A68S-T77N-M123I-A128P-G165Q-N184Q-G203Q-N217S | 209 |
| SQCBV235 | A68S-T77N-A128P-G165Q-N184Q-A202V-N217S-S258P | 210 |
| SQCBV236 | T3V-A68S-T77N-M123I-A128P-G165Q-N184Q-A202V-N217S-S258P | 211 |
| SQCBV237 | A68S-T77N-A128P-G165Q-N184Q-G203Q-N217S-S258P | 212 |
| SQCBV238 | T3V-A68S-T77N-M123I-A128P-G165Q-N184Q-G203Q-N217S-S258P | 213 |
| SQCBV239 | S86H-T115F-G127T-A143V-G165Q-N184Q-A202V-N217S-S258P | 214 |
| SQCBV240 | T3V-S86H-T115F-M123I-A143V-G165Q-A202V-N217S-S258P | 215 |
| SQCBV241 | A68S-T77N-A128P-S129H-G165Q-N184Q-A202V-N217S | 216 |
| SQCBV242 | T3V-A68S-T77N-M123I-A128P-S129H-G165Q-N184Q-A202V-N217S | 217 |

TABLE 22-continued

Additional AprL Protease Variants

| Sample ID | Sequence Substitutions Relative To AprL Parent | SEQ ID NO: |
|---|---|---|
| SQCBV243 | S86H-T115F-S129H-A143V-G165Q-N184Q-A202V-N217S-S258P | 218 |
| SQCBV244 | T3V-S86H-T115F-M123I-S129H-A143V-G165Q-A202V-N217S-S258P | 219 |
| SQCBV245 | A68S-T77N-A128P-S155N-G165Q-N184Q-A202V-N217S | 220 |
| SQCBV246 | T3V-A68S-T77N-M123I-A128P-S155N-G165Q-N184Q-A202V-N217S | 221 |
| SQCBV249 | I35A-A68S-T77N-V87S-A128P-V147L-G165Q-A202V-N217S | 222 |
| SQCBV250 | T3V-I35A-A68S-T77N-V87S-M123I-A128P-V147L-G165Q-A202V-N217S | 223 |
| SQCBV251 | A68S-T77N-A128P-Q136N-S155N-G165Q-N184Q-N217S-A242N | 224 |
| SQCBV252 | T3V-A68S-T77N-M123I-A128P-Q136N-S155N-G165Q-N184Q-N217S-A242N | 225 |
| SQCBV253 | A68S-V71A-T77N-A128P-G165Q-N184Q-A202V-N217S | 226 |
| SQCBV254 | T3V-A68S-V71A-T77N-M123I-A128P-G165Q-N184Q-A202V-N217S | 227 |
| SQCBV255 | A68S-T77N-A128P-G165Q-N184Q-S187P-A202V-N217S | 228 |
| SQCBV256 | T3V-A68S-T77N-M123I-A128P-G165Q-N184Q-S187P-A202V-N217S | 229 |
| SQCBV257 | A68S-T77N-A128R-G165Q-N184Q-A202V-N217S-S258D | 230 |
| SQCBV258 | T3V-A68S-T77N-M123I-A128R-G165Q-N184Q-A202V-N217S-S258D | 231 |
| SQCBV259 | A68S-T77N-A128P-S129R-G165Q-N184Q-N217S-S258D | 232 |
| SQCBV260 | T3V-A68S-T77N-M123I-A128P-S129R-G165Q-N184Q-N217S-S258D | 233 |
| SQCBV261 | A68S-T77N-A128R-G165Q-N184Q-A202V-N217S-S258D-K264H | 234 |
| SQCBV262 | T3V-A68S-T77N-M123I-A128R-G165Q-N184Q-A202V-N217S-S258D-K264H | 235 |
| SQCBV263 | A68S-T77N-A128R-G165Q-N184Q-G203E-S258D | 236 |
| SQCBV264 | T3V-A68S-T77N-M123I-A128R-G165Q-N184Q-G203E-S258D | 237 |
| SQCBV266 | T3V-A68S-T77N-M123I-A128R-G165Q-N184E-A202V-N217S-S258D | 238 |
| SQCBV268 | T3V-A52R-A68S-T77N-M123I-A128R-G165Q-N184E-A202V-N217S-S258D | 239 |
| SQCBV300 | T3V-T77N-S100N-G105N-D119Q-A128P-S158N-N160D-T161Q-G165A-N184Q-N217S-S258P-K264S | 240 |
| SQCBV301 | T3V-T77N-S100N-G105N-A128P-S158D-T161Q-G165A-N184Q-N217S-S258P | 241 |
| SQCBV302 | T3V-T77N-S100N-G105N-A128P-S158N-N160D-T161Q-G165A-N184Q-N217S-S258P | 242 |
| SQCBV303 | A24Q-V45I-A68S-T77N-S98R-E111Q-M123I-S158Q-G165E-N184Q-S187E-V204I-T210I-N217S-S259E | 243 |
| SQCBV304 | P9E-A52R-S86R-E111Q-S129R-S158Q-G165E-V204I-T210I-S258D-S259E-K264Q | 244 |
| SQCBV305 | T3V-A68S-T77N-G127T-A128P-G165Q-N184Q-A202V-N217S | 245 |
| SQCBV306 | T3V-I35A-T77N-V87S-M123I-A128P-G165Q-N184Q-A202V-N217S-A242G | 246 |
| SQCBV307 | T3V-A68S-T77N-G127E-A128P-G165Q-N184Q-A202V-N217S | 247 |
| SQCBV308 | T3V-A68S-T77N-M123I-G127V-A128P-G165Q-N184Q-N217S | 248 |
| SQCBV309 | T3V-A68S-T77N-M123I-A128P-A151G-G165Q-N184Q-N217S | 249 |
| SQCBV310 | T3V-A68S-T77N-G127T-A128P-A151G-G165Q-N184Q-N217S | 250 |
| SQCBV311 | T3V-T77N-M123I-A128P-A151G-G165Q-N184Q-A202V-N217S | 251 |
| SQCBV312 | T3V-A68S-T77N-L95F-A128P-G165Q-N184Q-A202V-N217S | 252 |
| SQCBV313 | T3V-A68S-T77N-L95A-M123I-A128P-G165Q-N184Q-N217S | 253 |
| SQCBV314 | T3V-A68S-T77N-L95F-M123I-A128P-G165Q-N184Q-N217S | 254 |
| SQCBV315 | T3V-A68S-T77N-G99A-A128P-G165Q-N184Q-A202V-N217S | 255 |
| SQCBV316 | T3V-A68S-T77N-G99E-A128P-G165Q-N184Q-A202V-N217S | 256 |
| SQCBV317 | T3V-A68S-T77N-G99Q-A128P-G165Q-N184Q-A202V-N217S | 257 |
| SQCBV318 | T3V-A68S-T77N-G99A-M123I-A128P-G165Q-N184Q-N217S | 258 |
| SQCBV319 | T3V-A68S-T77N-S108H-A128P-G165Q-N184Q-N217S | 259 |
| SQCBV320 | T3V-I35A-T77N-V87S-M123I-A128P-V146A-G165Q-N184Q-A202V-N217S-A242G | 260 |
| SQCBV321 | T3V-A68S-T77N-G127T-A128P-G165E-N184Q-A202V-N217S | 261 |
| SQCBV322 | T3V-A68S-T77N-M123I-A128P-V146A-G165Q-N184Q-N217S | 262 |
| SQCBV323 | T3V-A68S-T77N-M123I-A128P-T161D-G165Q-N184Q-A202V-N217S | 263 |
| SQCBV324 | T3V-V45R-A68S-T77N-S102D-A128P-T16ID-G165Q-N184Q-A202V-N217S | 264 |
| SQCBV325 | T3V-A68S-T77N-G127T-A128P-G165Q-N184Q-A202V-N217S-S258P | 265 |
| SQCBV326 | T3V-A68S-T77N-M123I-G127T-A128P-G165Q-N184Q-A202V-N217S-S258P | 266 |
| SQCBV327 | T3V-A68S-T77N-M123I-G127V-A128P-G165Q-N184Q-A202V-N217S-S258P | 267 |
| SQCBV328 | T3V-A68S-T77N-M123I-G127S-A128P-G165Q-N184Q-A202V-N217S-S258P | 268 |
| SQCBV329 | T3V-I35A-T77N-V87S-G127T-A128P-G165Q-N184Q-A202V-N217S-A242G-S258P | 269 |
| SQCBV330 | T3V-T77N-M123I-G127Q-A128P-G165Q-N184Q-A202V-N217S-S258P | 270 |
| SQCBV331 | T3V-T77N-M123I-G127V-A128P-G165Q-N184Q-A202V-N217S-S258P | 271 |
| SQCBV332 | T3V-T77N-M123I-G127E-A128P-G165Q-N184Q-A202V-N217S-S258P | 272 |
| SQCBV333 | T3V-A68S-T77N-M123I-G127T-A128P-G165Q-N184Q-A202V-N217S | 273 |
| SQCBV334 | T3V-A68S-T77N-M123I-G127T-A128P-G165Q-N184Q-A202V-T210P-N217S | 274 |
| SQCBV335 | T3V-A68S-T77N-M123I-A128P-G165Q-N184Q-A202V-T210P-N217S-S258P | 275 |
| SQCBV336 | T3V-A68S-T77N-M123I-G127T-A128P-G165Q-N184Q-A202V-N217S-S258D | 276 |
| SQCBV337 | L10M-I35A-T78I-V87S-M123I-A202V-S258D-F260W | 277 |
| SQCBV338 | L10M-I35A-T78I-V87S-M123I-A202V-F260W-K264H | 278 |
| SQCBV339 | L10M-I35A-T78I-V87S-A202V-S258D | 279 |
| SQCBV340 | L10M-I35A-T78I-V87S-S187E-A202V | 280 |
| SQCBV341 | L10M-T78I-V87S-S187E-A202V | 281 |
| SQCBV342 | L10M-I35A-T78I-S187E-A202V | 282 |
| SQCBV400 | T3V-L10M-A68S-T77N-M123I-G127S-A128P-G165Q-N184Q-A202V-N217S-S258P | 283 |
| SQCBV401 | T3V-I35A-A68S-T77N-M123I-G127S-A128P-G165Q-N184Q-A202V-N217S-S258P | 284 |

TABLE 22-continued

Additional AprL Protease Variants

| Sample ID | Sequence Substitutions Relative To AprL Parent | SEQ ID NO: |
|---|---|---|
| SQCBV402 | T3V-A68S-T77N-T78I-M123I-G127S-A128P-G165Q-N184Q-A202V-N217S-S258P | 285 |
| SQCBV403 | T3V-A68S-T77N-V87S-M123I-G127S-A128P-G165Q-N184Q-A202V-N217S-S258P | 286 |
| SQCBV404 | T3V-A68S-T77N-M123I-G127S-A128P-G165E-N184Q-A202V-N217S-S258P | 287 |
| SQCBV405 | T3V-A68S-T77N-M123I-G127S-A128P-G165Q-N184Q-A202V-T210P-N217S-S258P | 288 |
| SQCBV406 | T3V-A68S-T77N-M123I-G127S-A128P-G165Q-N184Q-A202V-L216Q-N217S-S258P | 289 |
| SQCBV407 | T3V-A68S-T77N-M123I-G127S-A128P-G165Q-N184Q-A202V-N217S-A242G-S258P | 290 |
| SQCBV408 | T3V-A68S-T77N-M123I-G127S-A128P-G165Q-N184Q-A202V-N217S-S258D | 291 |
| SQCBV409 | T3V-A68S-T77N-M123I-G127S-A128P-G165Q-N184Q-A202V-N217S-S258P-F260W | 292 |
| SQCBV410 | A68S-T77N-M123I-G127S-A128P-G165Q-N184Q-A202V-N217S-S258P | 293 |
| SQCBV411 | T3V-A68S-T77N-G127S-A128P-G165Q-N184Q-A202V-N217S-S258P | 294 |
| SQCBV412 | T3V-L31I-A68S-T77N-M123I-G127S-A128P-G165Q-N184Q-A202V-N217S-S258P | 295 |
| SQCBV413 | A68S-T77N-G127S-A128P-G165Q-N184Q-A202V-N217S-S258P | 296 |
| SQCBV414 | A68S-T77N-G127S-A128P-G165Q-N184Q-A202V-T210P-N217S-S258P | 297 |
| SQCBV415 | A68S-T77N-G127T-A128P-C165Q-N184Q-A202V-N217S-S258P | 298 |
| SQCBV416 | T3V-A68S-T77N-T78I-M123I-G127S-A128P-G165Q-N184Q-A202V-N217S-S258D | 299 |
| SQCBV417 | A68S-T77N-T78I-M123I-G127S-A128P-G165Q-N184Q-A202V-N217S-S258D | 300 |
| SQCBV418 | T3V-A68S-T77N-T78I-G127S-A128P-G165Q-N184Q-A202V-N217S-S258P | 301 |
| SQCBV419 | A68S-T77N-T78I-G127S-A128P-G165Q-N184Q-A202V-N217S-S258P | 302 |
| SQCBV420 | T3V-A68S-T77N-G127S-A128P-G165Q-N184Q-A202V-N217S-S258D | 303 |
| SQCBV421 | A68S-T77N-G127S-A128P-G165Q-N184Q-A202V-N217S-S258D | 304 |
| SQCBV422 | T3V-A68S-T77N-T78I-G127S-A128P-G165Q-NI84Q-A202V-N217S-S258D | 305 |
| SQCBV423 | A68S-T77N-T78I-G127S-A128P-G165Q-N184Q-A202V-N217S-S258D | 306 |
| SQCBV424 | T3V-A68S-T77N-S108H-G127S-A128P-G165Q-N184Q-A202V-N217S-S258P | 307 |
| SQCBV500 | T3V-A68S-T77N-G99Q-A128P-G165Q-N184Q-A202V-N217S-S258P | 308 |
| SQCBV501 | T3V-A68S-T77N-G99Q-A128P-G165Q-N184Q-A202V-T210P-N217S-S258P | 309 |
| SQCBV502 | T3V-A68S-T77N-G127S-A128P-G165E-N184Q-A202V-N217S-S258P | 310 |
| SQCBV504 | T3V-A68S-T77N-G127S-A128P-G165Q-N184Q-A202V-T210P-N217S-S258P | 311 |
| SQCBV505 | T3V-P9E-A68S-T77N-M123I-G127S-A128P-G165Q-N184Q-A202V-T210P-N217S-S258P | 312 |
| SQCBV506 | T3V-A68S-T77N-M123I-G127S-A128P-G165Q-N184Q-S187E-A202V-T210P-N217S-S258P | 313 |
| SQCBV507 | T3V-A68S-T77N-M123I-G127S-A128P-G165Q-N184Q-A202V-G203E-T210P-N217S-S258P | 314 |
| SQCBV508 | T3V-L10M-A68S-T77N-M123I-G127S-A128P-G165Q-N184Q-A202V-T210P-N217S-S258P | 315 |
| SQCBV509 | T3V-P9E-A68S-T77N-M123I-G127S-A128P-G165Q-N184Q-A202V-N217S-S258P | 316 |
| SQCBV510 | T3V-A68S-T77N-M123I-G127S-A128P-G165Q-N184Q-S187E-A202V-N217S-S258P | 317 |
| SQCBV512 | T3V-P9E-A68S-T77N-G127S-A128P-G165Q-N184Q-A202V-T210P-N217S-S258P | 318 |
| SQCBV513 | T3V-A68S-T77N-G127S-A128P-G165Q-N184Q-S187E-A202V-T210P-N217S-S258P | 319 |
| SQCBV514 | T3V-A68S-T77N-G127S-A128P-G165Q-N184Q-A202V-G203E-T210P-N217S-S258P | 320 |
| SQCBV515 | T3V-A68S-T77N-G101A-G127S-A128P-G165Q-N184Q-A202V-T210P-N217S-S258P | 321 |
| SQCBV516 | T3V-L10M-A68S-T77N-G127S-A128P-G165Q-N184Q-A202V-T210P-N217S-S258P | 322 |
| SQCBV517 | T3V-P9E-A68S-T77N-M123I-A128P-G165Q-N184Q-A202V-T210P-N217S-S258P | 323 |
| SQCBV518 | T3V-A68S-T77N-M123I-A128P-G165Q-N184Q-S187E-A202V-T210P-N217S-S258P | 324 |
| SQCBV519 | T3V-A68S-T77N-M123I-A128P-G165Q-N184Q-A202V-G203E-T210P-N217S-S258P | 325 |
| SQCBV520 | T3V-A68S-T77N-G101A-M123I-A128P-G165Q-N184Q-A202V-T210P-N217S-S258P | 326 |
| SQCBV521 | T3V-L10M-A68S-T77N-M123I-A128P-G165Q-N184Q-A202V-T210P-N217S-S258P | 327 |
| SQCBV522 | T3V-L10M-A68S-T77N-G101A-M123I-G127S-A128P-G165Q-N184Q-A202V-T210P-N217S-S258P | 328 |
| SQCBV523 | T3V-P9E-L10M-A68S-T77N-M123I-G127S-A128P-G165Q-N184Q-A202V-T210P-N217S-S258P | 329 |
| SQCBV524 | T3V-P9E-A68S-T77N-G99Q-A128P-G165Q-N184Q-A202V-T210P-N217S-S258P | 330 |
| SQCBV526 | T3V-A68S-T77N-M123I-G127S-A128P-G165Q-N184Q-A202V-T210P-N217S-S243I-S258P | 331 |

TABLE 22-continued

Additional AprL Protease Variants

| Sample ID | Sequence Substitutions Relative To AprL Parent | SEQ ID NO: |
|---|---|---|
| SQCBV527 | T3V-A68S-M123I-G127S-A128P-G165Q-N184Q-A202V-N217S-S258P | 332 |
| SQCBV529 | T3V-A68S-T77N-M123I-G127S-A128P-N184Q-A202V-N217S-S258P | 333 |
| SQCBV530 | T3V-A68S-T77N-M123I-G127S-A128P-G165Q-A202V-N217S-S258P | 334 |
| SQCBV531 | T3V-A68S-T77N-M123I-G127S-A128P-G165Q-N184Q-A202V-S258P | 335 |
| SQCBV532 | T3V-A68S-T77E-M123I-G127T-A128P-G165Q-N184Q-A202V-N217S-S258P | 336 |
| SQCBV533 | T3V-A68S-T77E-M123I-G127S-A128P-G165Q-N184Q-A202V-N217S-S258P | 337 |
| SQCBV534 | T3V-A68S-T77N-M123I-G127S-A128P-G165Q-N184Q-A202V-N217S-S258P-K264H | 338 |
| SQCBV535 | T3V-A68S-T77N-S102T-M123I-G127S-A128P-G165Q-N184Q-A202V-N211S-N217S-S258P | 339 |
| SQCBV536 | T3V-A68S-T77N-M123I-G127S-A128P-G165Q-N184Q-A202V-N211S-N217S-S258P | 340 |
| SQCBV537 | T3V-A68S-T77N-S102T-M123I-G127S-A128P-G165Q-N184Q-A202V-N217S-S258P | 341 |
| SQCBV538 | T3V-A68S-T77N-M123I-G127S-A128P-G165Q-N184Q-A202V-N217S-S258P-S259P | 342 |
| SQCBV539 | T3V-A68S-T77N-M123I-G127S-A128P-T161Q-G165Q-N184Q-A202V-N217S-S258P | 343 |
| SQCBV540 | T3V-A68S-T77N-M123I-G127S-A128P-S158Q-G165Q-N184Q-A202V-N217S-S258P | 344 |
| SQCBV541 | T3V-V45Q-A68S-T77N-M123I-G127S-A128P-G165Q-N184Q-A202V-N217S-S258P | 345 |
| SQCBV542 | T3V-A68S-T77N-M123I-G127S-A128P-G165Q-N184Q-A193Q-A202V-N217S-S258P | 346 |
| SQCBV543 | T3V-A68S-T77N-M123I-G127S-A128P-A143Q-G165Q-N184Q-A202V-N217S-S258P | 347 |
| SQCBV544 | T3V-A68S-T77N-G117S-M123I-G127S-A128P-G165Q-N184Q-A202V-N217S-S258P | 348 |
| SQCBV545 | T3V-A48V-A68S-T77N-M123I-G127S-A128P-G165Q-N184Q-A202V-N217S-S258P | 349 |
| SQCBV546 | T3V-A48T-A68S-T77N-M123I-GI27S-A128P-G165Q-N184Q-A202V-N217S-S258P | 350 |
| SQCBV547 | T3V-A29S-A68S-T77N-M123I-GI27S-A128P-G165Q-N184Q-A202V-N217S-S258P | 351 |
| SQCBV548 | T3V-A68S-T77N-G127S-A128P-G165Q-N184Q-A202V-N217S | 352 |
| SQCBV549 | T3V-A68S-T77N-G127S-A128P-G165Q-N184Q-N217S-S258P | 353 |
| SQCBV550 | T3V-A68S-T77N-A128P-G165Q-N184Q-A202V-N217S-S258P | 354 |
| SQCBV551 | A68S-T77N-M123I-G127S-A128P-G165Q-N184Q-A202V-N217S | 355 |
| SQCBV552 | A68S-T77N-M123I-A128P-G165Q-N184Q-A202V-N217S-S258P | 356 |
| SQCBV554 | T3V-A68S-T77N-G99Q-G127S-A128P-G165Q-N184Q-A202V-N217S-S258P | 357 |
| SQCBV555 | T3V-A68S-T77N-T78I-V87S-M123I-G127S-A128P-G165Q-N184Q-A202V-T210P-N217S-S258P | 358 |
| SQCBV556 | T3V-A68S-T77N-T78I-M123I-G127S-A128P-G165Q-N184Q-A202V-T210P-N217S-A242G-S258P | 359 |
| SQCBV557 | T3V-V26Q-A68S-T77N-M123I-G127S-A128P-G165E-N184Q-A202V-T210P-N217S-S258P | 360 |
| SQCBV558 | T3V-P9E-L10M-A68S-T77N-M123I-G127S-A128P-G165E-N184Q-A202V-T210P-N217S-S258P | 361 |
| SQCBV559 | T3V-P9E-L10M-A68S-T77N-G101A-M123I-G127S-A128P-G165Q-N184Q-A202V-N217S-S258P | 362 |
| SQCBV560 | T3V-A68S-T77N-T78I-M123I-G127S-A128P-G165Q-N184Q-A202V-T210P-N217S-S258P | 363 |
| SQCBV561 | T3V-A68S-T77N-T78I-M123I-G127S-A128P-N160K-G165Q-N184Q-A202V-T210P-N217S-A242G-S258P | 364 |
| SQCBV562 | T3V-A68S-T77N-V87S-M123I-G127S-A128P-G165Q-N184Q-A202V-T210P-N217S-S258P | 365 |
| SQCBV563 | T3V-A68S-P40E-T77N-M123I-G127S-A128P-G165Q-N184Q-A202V-N217S-S258P | 366 |
| SQCBV564 | T3V-A68S-T77E-M123I-G127T-A128P-G165E-N184Q-A202V-N217S-P238Q-S258P | 367 |
| SQCBV565 | T3V-A68S-T77N-G99S-M123I-G127S-A128P-G165Q-N184Q-A202V-N217S-S258P | 368 |
| SQCBV566 | T3V-A68S-T77E-M123I-G127T-G165E-N184Q-A202V-N217S-S258P | 369 |
| SQCBV567 | A68S-T77N-A128P-G165Q-N184Q-N217S-S258P | 370 |
| SQCBV568 | T3V-A68S-T77N-G101A-S102T-M123I-G127S-A128P-G165Q-N184Q-A202V-N217S-S258P | 371 |
| SQCBV569 | T3V-A68S-T77N-M123I-G127S-A128P-G165Q-N184Q-A202V-N217S | 372 |
| SQCBV570 | T3V-A68S-T77N-T78I-G99S-G127S-A128P-G165Q-T210P-A242G-S258P-K264H | 373 |
| SQCBV571 | T3V-A68S-T77N-T78I-G99S-M123I-G127S-A128P-G165Q-N184Q-A202V-T210P-N217S-A242G-S258P | 374 |
| SQCBV572 | T3V-A68S-T77N-M123I-G127T-G165E-N184Q-A202V-N217S-P238Q-S258P | 375 |
| SQCBV573 | T3V-A68S-T77N-T78I-G99S-G127S-A128P-G165Q-T210P-A242G-S258P | 376 |
| SQCBV574 | T3V-A68S-T77N-T78I-G99S-M123I-G127S-A128P-G165Q-N184Q-A202V-T210P-N217S-A242G-S258D | 377 |

TABLE 22-continued

Additional AprL Protease Variants

| Sample ID | Sequence Substitutions Relative To AprL Parent | SEQ ID NO: |
|---|---|---|
| SQCBV576 | I35A-M123I-G127T-T210P-S243I | 378 |
| SQCBV577 | T3V-A68S-T77N-G99S-M123I-G127S-A128P-G165Q-N184Q-A202V-N217S-S258P-F260W | 379 |
| SQCBV578 | T3V-A68S-T77N-T78I-G99S-G101A-G127S-A128P-G165Q-T210P-A242G-S258P | 380 |
| SQCBV579 | A68S-T77N-G99Q-A128P-G165Q-N184Q-N217S | 381 |
| SQCBV580 | A68S-T77N-A128P-G165Q-N184Q-A202V-N217S | 382 |
| SQCBV581 | A68S-T77N-A128P-G165Q-N184Q-N217S-S258D | 383 |
| SQCBV582 | T3V-A68S-T77N-T78I-G99S-G101A-M123I-G127S-A128P-G165Q-N184Q-A202V-T210P-N217S-A242G-S258P | 384 |
| SQCBV583 | V45R-S98R | 385 |

EXAMPLE 12

Laundry Cleaning Performance and Detergent Stability of Additional AprL Variants AprL Variants listed in Table 22 and SQCBV35 were tested as described in Example 1 for laundry cleaning performance and stability. BMI (EMPA-116) microswatches in Persil Non-Bio, Blue Moon, and Liby detergents (Table 2, assay conditions 6, 10, and 16) were used. Enzyme stability was tested in 10% Persil Non-Bio, Blue Moon, and Liby detergents at 62-65° C. (Table 2).

Table 23 shows the results for cleaning performance in Persil Non-Bio as PI values compared to the SQCBV35 variant (SEQ ID NO:63). Table 23 also shows the results for stability in 10% PNB at 62° C. for 15 min, 10% Blue Moon at 64° C. for 15 min, and 10% Liby at 65° C. for 15 min are reported as % remaining activity of sample after stress versus unstressed condition. Table 24 shows the results for cleaning performance in Persil Non-Bio (PNB), Blue Moon and Liby detergents as performance index (P) values compared to the SQCBV35 variant (SEQ ID NO:63). Table 24 also shows the results for stability in 10% PNB detergent at 62° C. for 15 min, 10% Blue Moon detergent at 64° C. for 15 min, and 10% Liby detergent at 65° C. for 15 min are reported as % remaining activity of sample after stress versus unstressed condition. Table 25 shows the results for cleaning performance in Persil Non-Bio detergent as PI values compared to the SQCBV35 variant (SEQ ID NO:63) using EMPA-116, CS-38 and CFT-10 stains. Table 25 also shows the results for stability in 10% PNB at 66° C. for 20 min, 10% Blue Moon at 68° C. for 20 min, and 10% Liby at 69° C. for 20 min are reported as % remaining activity of sample after stress versus unstressed condition. Table 26 provides the results for laundry cleaning performance and stability in Liby, Blue Moon and PNB detergents for various AprL variants. Stability conditions we described in Example 1 Table 2. Table 27 provides the performance of various AprL Variants in an aged laundry cleaning assay (performed as described in Example 1: Aged Laundry Cleaning Assay (A)). Aged cleaning performance is reported as % cleaning activity remaining after a 3 week incubation of samples in 100% Blue Moon detergent at 37° C.

TABLE 23

Laundry Cleaning CM AprL Variants Compared To SQCBV35, Reported As PI For Cleaning Assay And Stability As % Remaining Activity For Stability Assays

| | | Stability | | |
|---|---|---|---|---|
| Sample ID | Laundry PNB BMI | 10% Liby 65° C. | 10% Blue Moon 64° C. | 10% PNB 62° C. |
| SQCBV35 | 1.00 | 21 | 23 | 31 |
| SQCBV229 | 1.27 | 66 | 60 | 63 |
| SQCBV230 | 1.15 | 58 | 66 | 63 |
| SQCBV231 | 1.53 | 35 | 40 | 43 |
| SQCBV232 | 1.23 | 43 | 49 | 47 |
| SQCBV233 | 1.51 | 19 | 19 | 29 |
| SQCBV234 | 1.37 | 25 | 25 | 30 |
| SQCBV235 | 1.13 | 81 | 92 | 87 |
| SQCBV236 | 1.35 | 76 | 77 | 76 |
| SQCBV237 | 1.19 | 60 | 55 | 47 |
| SQCBV238 | 1.40 | 47 | 57 | 56 |
| SQCBV239 | 1.45 | 46 | 45 | 73 |
| SQCBV240 | 1.54 | 42 | 34 | 65 |
| SQCBV241 | 1.09 | 65 | 61 | 73 |
| SQCBV242 | 1.24 | 59 | 56 | 78 |
| SQCBV243 | 1.16 | 43 | 50 | 68 |
| SQCBV244 | 1.36 | 47 | 35 | 79 |
| SQCBV245 | 1.14 | 67 | 58 | 88 |
| SQCBV246 | 1.28 | 64 | 65 | 71 |
| SQCBV249 | 1.08 | 94 | 78 | 82 |
| SQCBV250 | 0.94 | 84 | 87 | 93 |
| SQCBV251 | 1.14 | 39 | 37 | 42 |
| SQCBV252 | 1.08 | 30 | 35 | 59 |
| SQCBV253 | 1.05 | 59 | 53 | 56 |
| SQCBV254 | 1.07 | 53 | 55 | 71 |
| SQCBV255 | 1.18 | 67 | 73 | 92 |
| SQCBV256 | 1.16 | 77 | 58 | 70 |
| SQCBV257 | 0.88 | 85 | 85 | 86 |
| SQCBV258 | 1.19 | 74 | 53 | 95 |
| SQCBV259 | 1.10 | 53 | 52 | 71 |
| SQCBV260 | 1.18 | 49 | 58 | 45 |
| SQCBV261 | 0.96 | 78 | 100 | 96 |
| SQCBV262 | 1.12 | 78 | 78 | 96 |
| SQCBV263 | 1.13 | 59 | 66 | 60 |
| SQCBV264 | 1.24 | 52 | 45 | 50 |
| SQCBV266 | 1.06 | 78 | 89 | 100 |
| SQCBV268 | 0.93 | 75 | 74 | 79 |

TABLE 24

Laundry Cleaning Of AprL Variants Compared To SQCBV35, Reported As PI For Cleaning Assays And Stability As % Remaining Activity For Stability Assays

| | HDL/BMI | | | Stability | | |
|---|---|---|---|---|---|---|
| Sample ID | Liby | Blue Moon | PNB | 10% Liby 65° C. | 10% Blue Moon 64° C. | 10% PNB 62° C. |
| SQCBV35 | 1.00 | 1.00 | 1.00 | 32 | 33 | 41 |
| SQCBV300 | 0.52 | 0.74 | 0.81 | 86 | 89 | 89 |
| SQCBV301 | 0.76 | 0.82 | 1.07 | 62 | 58 | 48 |
| SQCBV302 | 0.67 | 0.77 | 0.94 | 71 | 58 | 74 |
| SQCBV303 | 0.57 | 0.90 | 0.78 | 33 | 44 | 76 |
| SQCBV304 | 0.69 | 0.63 | 0.59 | 12 | 29 | 20 |
| SQCBV305 | 1.10 | ND | 1.21 | 94 | 77 | 88 |
| SQCBV306 | 0.84 | 0.95 | 1.07 | 99 | 100 | 64 |
| SQCBV307 | 0.89 | ND | 1.09 | 80 | 84 | 63 |
| SQCBV308 | 0.75 | 0.78 | 0.89 | 33 | 36 | 56 |
| SQCBV309 | 0.90 | 0.86 | 1.08 | 33 | 24 | 37 |
| SQCBV310 | 0.80 | 0.82 | 0.98 | 26 | 20 | 38 |
| SQCBV311 | 0.73 | 0.89 | 1.00 | 61 | 58 | 73 |
| SQCBV312 | 1.05 | 0.95 | 0.97 | 52 | 40 | 66 |
| SQCBV313 | 0.82 | 0.81 | 1.08 | 49 | 46 | 53 |
| SQCBV314 | 1.03 | 1.06 | 1.05 | 23 | 11 | 29 |
| SQCBV315 | 1.09 | 1.04 | 1.12 | 68 | 64 | 72 |
| SQCBV316 | 1.12 | 0.96 | 1.05 | 80 | 72 | 81 |
| SQCBV317 | 1.25 | 1.13 | 1.06 | 65 | 75 | 95 |
| SQCBV318 | 1.51 | 1.16 | 1.06 | 32 | 22 | 36 |
| SQCBV319 | 0.92 | 0.90 | 0.94 | 33 | 34 | 50 |
| SQCBV320 | 0.96 | 1.00 | 1.02 | 100 | 81 | 99 |
| SQCBV321 | 1.21 | 0.89 | 1.25 | 82 | 83 | 94 |
| SQCBV322 | 1.06 | 0.99 | 1.10 | 42 | 32 | 50 |
| SQCBV323 | 0.86 | 0.85 | 1.00 | 75 | 56 | 61 |
| SQCBV324 | 0.94 | 0.93 | 0.99 | 84 | 85 | 85 |
| SQCBV325 | 1.11 | 1.00 | 1.17 | 80 | 87 | 92 |
| SQCBV326 | 1.04 | 0.99 | 1.12 | 80 | 93 | 92 |
| SQCBV327 | 0.70 | 0.82 | 0.82 | 61 | 91 | 100 |
| SQCBV328 | 1.12 | 1.01 | 1.04 | 100 | 100 | 100 |
| SQCBV329 | 0.94 | 0.83 | 0.92 | 96 | 100 | 95 |
| SQCBV330 | 0.87 | 0.91 | 1.07 | 76 | 89 | 82 |
| SQCBV331 | 0.70 | 0.77 | 0.94 | 63 | 97 | 100 |
| SQCBV332 | 0.73 | 0.59 | 0.99 | 88 | 100 | 100 |
| SQCBV333 | 1.17 | 1.01 | 1.21 | 84 | 91 | 72 |
| SQCBV334 | 1.18 | 1.19 | 1.03 | 84 | 75 | 83 |
| SQCBV335 | 1.01 | 0.93 | 0.99 | 90 | 99 | 89 |
| SQCBV336 | 0.81 | 0.94 | 1.15 | 81 | 100 | 100 |
| SQCBV337 | 0.74 | 1.22 | 1.19 | 98 | 94 | 88 |
| SQCBV338 | 1.18 | ND | 1.17 | 72 | 97 | 91 |
| SQCBV339 | 0.80 | ND | 0.96 | 76 | 64 | 89 |
| SQCBV340 | 0.87 | ND | 1.02 | 59 | 36 | 50 |
| SQCBV341 | 0.84 | 0.69 | 1.00 | 37 | 19 | 34 |
| SQCBV342 | 0.82 | ND | 1.06 | 56 | 35 | 41 |

TABLE 25

Laundry Cleaning Of APrL Variants Compared To SQCBV35 Variant, Reported As PI For Cleaning Assays And Stability As As % Remaining Activity For Stability Assays

| | HDL/BMI EMPA-116 | | | HDL/Egg CS-38 | | | HDL/POM CFT-10 | | | Stability | | |
|---|---|---|---|---|---|---|---|---|---|---|---|---|
| Sample ID | Liby | Blue Moon | PNB | Liby | Blue Moon | PNB | Liby | Blue Moon | PNB | 10% Liby 69° C. | 10% Blue Moon 68° C. | 10% PNB 66° C. |
| SQCBV35 | 1.00 | 1.00 | 1.00 | 1.00 | 1.00 | 1.00 | 1.00 | 1.00 | 1.00 | <1% | <1% | <1% |
| SQCBV500 | 0.97 | 0.79 | 0.94 | 1.58 | 1.55 | 1.09 | 1.16 | 0.80 | 0.18 | 57 | 49 | 50 |
| SQCBV501 | 0.79 | 0.80 | 0.89 | 1.41 | 1.41 | 1.01 | 1.11 | 0.72 | 0.12 | 56 | 51 | 48 |
| SQCBV502 | 1.11 | 0.82 | 1.09 | 1.36 | 1.42 | 1.20 | 1.26 | 1.31 | 0.92 | 57 | 42 | 51 |
| SQCBV503 | 0.92 | 0.80 | 0.92 | 1.36 | 1.22 | 0.90 | 1.86 | 1.06 | 0.84 | 69 | 50 | 59 |
| SQCBV504 | 1.03 | 0.84 | 0.91 | 1.43 | 1.28 | 1.09 | 1.40 | 1.20 | 1.30 | 54 | 41 | 51 |
| SQCBV505 | 0.86 | 0.64 | 0.78 | 1.23 | 1.33 | 1.09 | 1.40 | 1.02 | 1.33 | 87 | 69 | 69 |
| SQCBV506 | 1.10 | 0.85 | 0.99 | 1.45 | 1.50 | 1.26 | 1.91 | 1.20 | 0.89 | 54 | 31 | 40 |
| SQCBV507 | 0.82 | 0.70 | 0.97 | 1.14 | 1.30 | 1.07 | 1.28 | 0.91 | 0.57 | 71 | 57 | 58 |
| SQCBV508 | 1.25 | 0.89 | 1.03 | 1.12 | 1.17 | 0.93 | 1.47 | 1.03 | 1.03 | 64 | 47 | 51 |
| SQCBV509 | 0.92 | 0.78 | 0.95 | 1.15 | 1.20 | 0.94 | 1.47 | 1.15 | 0.95 | 64 | 51 | 53 |
| SQCBV510 | 0.95 | 0.88 | 0.87 | 1.23 | 1.26 | 0.96 | 1.47 | 0.82 | 0.61 | 59 | 42 | 48 |
| SQCBV511 | 1.10 | 0.81 | 1.11 | 1.42 | 1.35 | 1.13 | 1.89 | 1.09 | 1.03 | 61 | 45 | 49 |
| SQCBV512 | 0.84 | 0.76 | 0.82 | 1.06 | 1.20 | 0.98 | 1.33 | 1.17 | 1.11 | 83 | 84 | 75 |
| SQCBV513 | 1.09 | 0.91 | 1.07 | 1.31 | 1.27 | 0.99 | 1.75 | 1.10 | 0.95 | 70 | 54 | 62 |
| SQCBV514 | 1.27 | 0.98 | 1.16 | 1.12 | 1.21 | 0.99 | 1.44 | 1.19 | 0.81 | 81 | 72 | 73 |
| SQCBV515 | 0.67 | 0.75 | 0.85 | 0.62 | 0.75 | 0.54 | 1.38 | 0.93 | 0.72 | 53 | 32 | 42 |
| SQCBV516 | 1.07 | 0.82 | 0.90 | 1.07 | 1.17 | 0.83 | 1.16 | 1.03 | 0.84 | 79 | 64 | 65 |
| SQCBV517 | 0.76 | 0.72 | 0.81 | 0.98 | 1.07 | 0.87 | 1.56 | 1.02 | 0.80 | 79 | 73 | ND |
| SQCBV518 | 0.68 | 0.64 | 0.91 | 1.22 | 1.20 | 1.03 | 1.52 | 1.07 | 0.78 | 61 | 38 | 48 |
| SQCBV519 | 0.77 | 0.68 | 0.79 | 1.32 | 1.36 | 1.20 | 1.23 | 1.11 | 0.99 | 74 | 61 | 63 |
| SQCBV520 | 0.84 | 0.80 | 0.94 | 1.01 | 1.17 | 0.82 | 1.23 | 1.18 | 1.04 | 36 | 18 | 26 |
| SQCBV521 | 0.84 | 0.77 | 0.97 | 1.09 | 1.24 | 0.91 | 1.26 | 1.06 | 0.99 | 68 | 57 | 58 |
| SQCBV522 | 0.63 | 0.72 | 0.87 | 0.81 | 0.85 | 0.46 | 1.60 | 0.93 | 0.71 | 59 | 39 | 38 |
| SQCBV523 | 0.96 | 0.76 | 0.81 | 1.06 | 1.15 | 0.97 | 1.02 | 1.03 | 0.77 | 79 | 72 | 66 |
| SQCBV524 | 0.58 | 0.78 | 0.87 | 1.06 | 1.14 | 0.89 | 1.04 | 0.62 | 0.46 | 86 | 77 | 67 |
| SQCBV526 | 1.09 | 0.82 | 0.98 | 1.34 | 1.19 | 0.93 | 1.78 | 1.36 | 0.96 | 39 | 20 | 30 |
| SQCBV527 | 1.13 | 0.92 | 1.04 | 1.38 | 1.24 | 1.21 | 0.81 | 1.04 | 0.76 | 19 | 10 | 16 |
| SQCBV529 | 1.29 | 0.94 | 1.02 | 1.47 | 1.27 | 1.05 | 0.94 | 0.96 | 0.60 | 14 | 6 | 7 |
| SQCBV530 | 1.03 | 0.95 | 1.01 | 1.14 | 1.12 | 1.10 | 1.08 | 0.96 | 0.83 | 32 | 21 | 27 |
| SQCBV531 | 1.16 | 0.94 | 1.01 | 1.37 | 1.18 | 1.04 | 0.74 | 0.92 | 0.90 | 19 | 9 | 15 |

TABLE 25-continued

Laundry Cleaning Of APrL Variants Compared To SQCBV35 Variant, Reported As PI For Cleaning Assays And Stability As As % Remaining Activity For Stability Assays

| Sample ID | HDL/BMI EMPA-116 | | | HDL/Egg CS-38 | | | HDL/POM CFT-10 | | | Stability | | |
|---|---|---|---|---|---|---|---|---|---|---|---|---|
| | Liby | Blue Moon | PNB | Liby | Blue Moon | PNB | Liby | Blue Moon | PNB | 10% Liby 69° C. | 10% Blue Moon 68° C. | 10% PNB 66° C. |
| SQCBV532 | 0.90 | 0.78 | 0.94 | 1.01 | 0.94 | 0.73 | 1.31 | 0.71 | 0.80 | 73 | 62 | 52 |
| SQCBV533 | 0.95 | 0.92 | 0.95 | 1.14 | 1.00 | 0.94 | 0.82 | 0.89 | 0.66 | 69 | 58 | 57 |
| SQCBV534 | 1.59 | 1.00 | 1.12 | 1.24 | 1.09 | 1.01 | 1.40 | 1.07 | 1.09 | 64 | 60 | 55 |
| SQCBV535 | 1.23 | 0.93 | 1.05 | 1.05 | 1.00 | 1.09 | 1.20 | 0.89 | 0.89 | 53 | 34 | 39 |
| SQCBV536 | 1.07 | 0.96 | 1.05 | 1.02 | 1.04 | 1.01 | 0.63 | 0.92 | 1.05 | 45 | 36 | 37 |
| SQCBV537 | 1.01 | 0.95 | 1.09 | 0.99 | 0.95 | 0.91 | 0.87 | 0.98 | 1.32 | 43 | 34 | 39 |
| SQCBV538 | 0.89 | 0.82 | 1.00 | 1.06 | 0.90 | 0.96 | 0.87 | 0.99 | 1.69 | 59 | 38 | 43 |
| SQCBV539 | 1.02 | 0.93 | 1.01 | 1.14 | 1.00 | 0.95 | 1.13 | 1.12 | 1.59 | 48 | 36 | 39 |
| SQCBV540 | 1.06 | 0.86 | 1.10 | 1.13 | 1.07 | 1.04 | 0.70 | 0.89 | 1.03 | 48 | 35 | 41 |
| SQCBV541 | 1.06 | 0.95 | 0.99 | 1.31 | 1.08 | 1.10 | 1.01 | 1.03 | 1.68 | 38 | 26 | 32 |
| SQCBV542 | 1.18 | 0.85 | 0.93 | 1.32 | 1.09 | 1.04 | 1.16 | 0.98 | 1.10 | 44 | 30 | 38 |
| SQCBV543 | 1.20 | 0.96 | 1.27 | 1.21 | 1.09 | 1.15 | 1.01 | 1.18 | 2.05 | 41 | 30 | 36 |
| SQCBV544 | 1.12 | 0.87 | 1.05 | 1.09 | 0.95 | 1.03 | 1.31 | 1.13 | 1.24 | 42 | 28 | 29 |
| SQCBV545 | 1.30 | 0.89 | 1.21 | 1.22 | 1.04 | 1.17 | 0.83 | 1.15 | 1.68 | 35 | 22 | 16 |
| SQCBV546 | 1.32 | 0.92 | 1.06 | 0.89 | 0.98 | 1.01 | 1.11 | 0.95 | 1.44 | 37 | 26 | 30 |
| SQCBV547 | 0.96 | 0.91 | 0.89 | 1.11 | 1.01 | 0.94 | 1.02 | 0.96 | 1.59 | 22 | 11 | 13 |
| SQCBV548 | 1.25 | 1.07 | 0.88 | 1.33 | 1.20 | 1.09 | 1.28 | 1.03 | 0.96 | 33 | 19 | 28 |
| SQCBV549 | 1.43 | 1.12 | 1.01 | 1.31 | 1.15 | 1.18 | 1.05 | 1.21 | 0.94 | 6 | 4 | 6 |
| SQCBV550 | 0.76 | 0.91 | 0.85 | 0.92 | 0.96 | 0.68 | 0.68 | 0.84 | 0.66 | 71 | 59 | 62 |
| SQCBV551 | 1.14 | 1.10 | 1.04 | 1.08 | 1.20 | 1.14 | 0.77 | 1.01 | 1.10 | 5 | ND | 5 |
| SQCBV552 | 0.95 | 0.89 | 0.91 | 1.05 | 0.94 | 0.98 | 0.78 | 0.87 | 1.04 | 26 | 23 | ND |

TABLE 26

Laundry Cleaning Of AprL Variants Compared To SQCBV35, Reported As PI For Cleaning Assays And Stability As % Remaining Activity For Stability Assays

| SAMPLE ID | HDL/BMI EMPA-116 | | | Stability | | |
|---|---|---|---|---|---|---|
| | Liby | Blue Moon | PNB | 10% Liby, 69° C. | 10% Blue Moon, 68° C. | 10% PNB, 66° C. |
| SQCBV35 | 1.00 | 1.00 | 1.00 | 0.1 | 0.0 | 0.1 |
| SQCBV400 | 1.07 | 1.05 | 1.05 | 69.8 | 66.9 | 66.1 |
| SQCBV401 | 1.11 | 1.11 | 1.08 | 53.9 | 46.3 | 51.3 |
| SQCBV402 | 1.11 | 1.11 | 1.06 | 85.2 | 86.3 | 84.3 |
| SQCBV403 | 1.07 | 0.99 | 0.94 | 68.0 | 65.7 | 74.3 |
| SQCBV404 | 1.07 | 1.05 | 1.11 | 43.3 | 35.5 | 49.8 |
| SQCBV405 | 1.10 | 1.08 | 1.04 | 50.5 | 47.3 | 47.2 |
| SQCBV406 | 1.21 | 1.18 | 1.11 | 21.2 | 18.7 | 25.3 |
| SQCBV407 | 1.20 | 1.05 | 1.02 | 64.1 | 59.0 | 62.3 |
| SQCBV408 | 0.88 | 1.02 | 1.05 | 61.2 | 57.1 | 54.1 |
| SQCBV409 | 0.90 | 1.00 | 1.06 | 64.2 | 62.8 | 61.5 |
| SQCBV410 | 1.07 | 1.02 | 1.08 | 41.1 | 34.8 | 41.3 |
| SQCBV411 | 0.88 | 0.94 | 0.90 | 60.9 | 59.6 | 56.5 |
| SQCBV412 | 1.15 | 1.00 | 1.01 | 49.9 | 44.6 | 48.3 |
| SQCBV413 | 1.07 | 0.97 | 0.97 | 58.3 | 46.7 | 60.2 |
| SQCBV414 | 0.95 | 0.94 | 0.98 | 63.1 | 49.7 | 43.8 |
| SQCBV415 | 1.20 | 1.12 | 1.18 | 59.6 | 51.3 | 58.8 |
| SQCBV416 | 0.88 | 0.98 | 1.05 | 93.3 | 93.8 | 91.7 |
| SQCBV417 | 0.98 | 0.95 | 0.98 | 101.9 | 69.9 | 72.6 |
| SQCBV418 | 0.98 | 0.96 | 1.01 | 71.1 | 75.2 | 81.6 |
| SQCBV419 | 0.94 | 0.93 | 0.93 | 78.3 | 78.2 | 72.1 |
| SQCBV420 | 0.87 | 0.82 | 0.90 | 75.6 | 57.8 | 66.2 |
| SQCBV421 | 0.79 | 0.87 | 0.95 | 56.6 | 53.1 | 59.0 |
| SQCBV422 | 0.98 | 0.91 | 0.96 | 86.7 | 72.1 | 83.2 |
| SQCBV423 | 0.81 | 0.92 | 0.99 | 87.0 | 74.1 | 83.0 |
| SQCBV424 | 0.86 | 0.86 | 0.89 | 77.8 | 58.5 | 64.7 |

TABLE 27

Aged Laundry Cleaning Performance Of AprL Variants Compared To SQCBV35 Parent, Reported As % Remaining Cleaning Activity

| Sample ID | % Remaining Cleaning Activity After 3 weeks at 37° C. |
|---|---|
| SQCBV35 | 47 |
| SQCBV505 | 69 |
| SQCBV512 | 84 |
| SQCBV514 | 72 |
| SQCBV516 | 64 |
| SQCBV517 | 73 |
| SQCBV519 | 61 |
| SQCBV523 | 72 |
| SQCBV524 | 77 |
| SQCBV532 | 62 |
| SQCBV534 | 60 |
| SQCBV554 | 67 |
| SQCBV555 | 93 |
| SQCBV556 | 71 |
| SQCBV557 | 66 |
| SQCBV558 | 65 |
| SQCBV559 | 81 |
| SQCBV560 | 67 |
| SQCBV561 | 72 |
| SQCBV562 | 62 |
| SQCBV563 | 63 |
| SQCBV564 | 65 |
| SQCBV565 | 64 |
| SQCBV566 | 83 |

EXAMPLE 13

ADW Cleaning Performance and Detergent Stability of Additional AprL Variants The cleaning performance of AprL protease variants listed in Table 22, AprL wt and SQCBV35 was measured in dish based applications (ADW) using various detergent formulas listed on Table 1.1, and pre-punched egg yolk microswatches (PAS-38) that were either pre-rinsed or unrinsed prior to assays. To prepare pre-rinsed PAS-38 swatches, 180 µl 10 mM CAPS buffer pH 11 was added to MTPs containing microswatches, and plates were sealed and incubated in an iEMS incubator for 30 min at 60° C. and 1100 rpm. The buffer was then removed, and the swatches were rinsed with deionized water and air dried. To measure enzyme cleaning in the ADW formulas, 175 µL of the detergent solution (3 g/L detergent prepared in 374 ppm water hardness) was added to each well of the MTPs, followed by the addition of 5 µL of enzyme. The MTP was sealed and incubated in an iEMS incubator for 30 min at 40° C. and 1100 rpm. After incubation, 100 µL of wash liquid from each well was transferred to a new MTP, and the absorbance of this supernatant was measured at 405 nm on a SpectraMax plate reader. The net absorbance was obtained by subtracting the value for a blank control (no enzyme) from each sample in the GSM-B pH 10.5 formula. When using the Custom liquid ADW Detergent Formula (at pH and 9) all the supernatant was removed from the MTP wells after the enzyme incubation and transferred to another MTP to determine the absorbance at 405 nm. The swatches in the MTPs were rinsed with deionized water, then 180 µL 10 mM CAPS buffer pH 11 was added per well and the plates were incubated in an iEMS incubator for another 10 min at 40° C. and 1100 rpm. After this last incubation, 100 µL of the resulting wash liquid was transferred to anew MTP, and the absorbance was measured at 405 nm. To determine total cleaning performance in the Custom liquid ADW Detergent Formula (at pH 7 and 9), the two absorbance measurements taken were added, and this total value was used to calculate the performance index (PI) for each enzyme.

In all instances, the PI was calculated for each condition and protease variant by dividing the blank subtracted total absorbance by that of the parent protease (tested at the same concentration). The value for the parent protease was determined from a standard curve of the parent protease which was included in the test and which was fitted to a Langmuir fit. Table 28 shows the ADW performance results for AprL Variants (using either rinsed or unrinsed swatches) tested in either GSM-B pH 10.5 or Custom Liquid ADW Detergent Formula (adjusted to pH 7 and pH 9). The results are reported as PI values compared to AprL wild-type protease (AprL wt).

TABLE 28

ADW Cleaning Performance Of AprL Variants Tested in GSM-B and Custom ADW Formulas, compared To AprL, Reported As PI

| Sample ID | GSMB pH 10.5 Rinsed | GSMB pH 10.5 Unrinsed | Custom ADW pH 7 Rinsed | Custom ADW pH 7 Unrinsed | Custom ADW pH 9 Rinsed | Custom ADW pH 9 Unrinsed |
|---|---|---|---|---|---|---|
| AprL wt | 1.0 | 1.0 | 1.0 | 1.0 | 1.0 | 1.0 |
| SQCBV35 | 1.0 | 1.0 | 1.0 | 1.1 | 1.0 | 1.0 |
| SQCBV236 | 1.2 | 1.4 | 1.1 | 1.4 | 1.0 | 1.2 |
| SQCBV502 | 1.0 | 1.8 | 1.1 | 1.4 | 1.1 | 1.3 |
| SQCBV503 | 1.0 | 1.5 | 1.1 | 1.3 | 1.1 | 1.4 |
| SQCBV504 | 1.0 | 1.3 | 1.0 | 1.1 | 1.1 | 1.2 |
| SQCBV527 | 1.0 | 0.9 | 1.0 | 1.3 | 1.0 | 1.0 |
| SQCBV535 | 1.0 | 1.0 | 1.0 | 1.1 | 0.9 | 1.2 |
| SQCBV540 | 0.9 | 0.8 | 1.1 | 1.1 | 1.0 | 1.1 |
| SQCBV563 | 0.9 | 7.4 | 1.1 | 1.7 | 1.0 | 2.4 |
| SQCBV564 | 1.1 | 1.1 | 1.0 | 1.1 | 0.9 | 1.1 |
| SQCBV566 | 1.1 | 1.3 | 1.1 | 1.1 | 1.1 | 1.2 |
| SQCBV567 | 1.4 | 1.5 | 1.3 | 1.3 | 1.1 | 1.2 |
| SQCBV568 | 1.0 | 1.0 | 1.1 | 1.1 | 1.1 | 1.2 |
| SQCBV569 | 1.2 | 1.2 | 1.2 | 1.4 | 1.0 | 1.3 |
| SQCBV570 | 1.2 | 1.6 | 1.0 | 1.4 | 1.1 | 1.3 |
| SQCBV571 | 1.2 | 1.5 | 1.0 | 1.3 | 1.0 | 1.1 |
| SQCBV572 | 1.1 | 1.3 | 1.0 | 1.2 | 1.0 | 1.2 |
| SQCBV573 | 1.0 | 1.3 | 0.9 | 1.3 | 0.9 | 1.2 |
| SQCBV574 | 1.1 | 1.2 | 1.0 | 1.3 | 1.0 | 1.2 |
| SQCBV576 | 1.1 | 1.4 | 1.0 | 1.3 | 1.0 | 1.2 |

TABLE 28-continued

ADW Cleaning Performance Of AprL Variants Tested in GSM-B and Custom ADW Formulas, compared To AprL, Reported As PI

| Sample ID | GSMB pH 10.5 Rinsed | GSMB pH 10.5 Unrinsed | Custom ADW pH 7 Rinsed | Custom ADW pH 7 Unrinsed | Custom ADW pH 9 Rinsed | Custom ADW pH 9 Unrinsed |
|---|---|---|---|---|---|---|
| SQCBV577 | 1.1 | 1.1 | 1.0 | 1.3 | 1.0 | 1.2 |
| SQCBV578 | 1.0 | 1.1 | 1.1 | 1.2 | 1.0 | 1.1 |
| SQCBV579 | 0.6 | 1.1 | 1.0 | 1.0 | 0.9 | 1.1 |
| SQCBV580 | 0.9 | 1.1 | 1.1 | 1.1 | 1.1 | 1.2 |
| SQCBV581 | 0.9 | 1.0 | 1.0 | 1.1 | 1.1 | 1.1 |
| SQCBV582 | 1.0 | 1.1 | 1.0 | 1.2 | 1.0 | 1.1 |
| SQCBV583 | 1.4 | 1.1 | 0.9 | 0.9 | 1.2 | 1.2 |

SEQUENCE LISTING (385 sequences)

SEQ ID NO: 1 - DNA, 822 bp, artificial sequence
  synthetic AprL gene B. licheniformis
gcgcaaaccgttccttacggcattcctctcattaaagcggacaaagtgcaggctcaaggctttaagggagcgaatgtaaaagtagccgtcctggatacaggaatccaagcatctcatccggacttgaacgtagtcggcggagcgagctttgtggctggcgaagcatataacaccgacggcaacggacacggcacacatgttgccggtacagtagctgcgcttgacaatacaacgggtgtattaggcgttgcgccaagcgtatccttgtacgcggttaaagtactgaactcaagcggaagcggatcatacagcggcattgtaagcggaatcgagtgggcgacaacaaacggcatggatgttatcaatatgagccttgggggagcatcaggctcgacagcgatgaaacaggcagtcgacaatgcatacgcaagaggggttgtcgttgtagcagcagctgggaacagcggatcttcaggaaacacgaatacaattggctatcctgcgaaatacgattctgtcatcgctgttggcgcggtagactctaacagcaacagagcttcattttccagtgtgggagcagagcttgaagtcatggctcctggcgcaggcgtatacagcacttacccaacgaacacttatgcaacattgaacggaacgtcaatggcttctcctcatgtagcgggagcagcagctttgatcttgtcaaaacatccgaacctttcagcttcacaagtccgcaaccgtctctccagcacggcgacttatttgggaagctccttctactatgggaaaggtctgatcaatgtcgaagctgccgctcaa

SEQ ID NO: 2 - protein, 274 aa, B. licheniformis
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 3 - DNA, 607 bp, B subtilis
attcctccattttcttctgctatcaaaataacagactcgtgattttccaaacgagctttcaaaaaagcctctgccccttgcaaatcggatgcctgtctataaaattcccgatattggttaaacagcggcgcaatggcggccgcatctgatgtctttgcttggcgaatgttcatcttatttcttcctccctctcaataattttttcattctatcccttttctgtaaagtttatttttcagaatacttttatcatcatgctttgaaaaaatatcacgataatatccattgttctcacggaagcacacgcaggtcatttgaacgaattttttcgacaggaatttgccgggactcaggagcatttaacctaaaaaagcatgacatttcagcataatgaacatttactcatgtctattttcgttcttttctgtatgaaaatagttatttcgagtctctacggaaatagcgagagatgatatacctaaatagagataaaatcatctcaaaaaaatgggtctactaaaatattattccatctattacaataaattcacagaatagtcttttaagtaagtctactctgaatttttttaaaaggagagggtaacta

SEQ ID NO: 4 - DNA, 87 bp, B subtilis
gtgagaagcaaaaaattgtggatcagcttgttgtttgcgttaacgttaatctttacgatggcgttcagcaacatgtctgctagcgca

SEQ ID NO: 5 - DNA, 228 bp, B. licheniformis
gctcaaccggcgaaaaatgttgaaaaggattatattgtcggatttaagtcaggagtgaaaaccgcatctgtcaaaaaggacatcatcaaagagagcggcggaaaagtggacaagcagtttagaatcatcaacgcggcaaaagcgaagctagacaaagaagcgcttaaggaagtcaaaaatgatccggatgtcgcttatgtggaagaggatcatgtggcccatgccttg

SEQ ID NO: 6 - DNA, 247 bp, B. amyloliquefaciens
acataaaaaaccggccttggccccgccggttttttattatttttcttcctccgcatgttcaatccgctccataatcgacggatggctccctctgaaaattttaacgagaaacggcgggttgacccggctcagtcccgtaacggccaagtcctgaaacgtctcaatcgccgcttcccggtttccggtcagctcaatgccgtaacggtcggcggcgttttcctgataccgggagacggcattcgtaatc

SEQ ID NO: 7 - DNA, 822 bp, artificial sequence
  synthetic BliD02339 gene B. licheniformis strain Bra7
gcgcaaaccgttccttacggcattcctctcattaaagcggacaaagtgcaggctcaaggctttaagggagcgaatgtaaaagtagccgtcctggatacaggaatccaagcttctcatccggacttgaacgtagtcggcggagcaagctttgtggctggcgaagcttataacaccgacggcaacggacacggcacgcatgttgccggtacagtagctgcgcttgacaatacaacgggtgtattaggcgttgcgccgaacgtatccttgtacgcggttaaagtgctgaattcaagcggaagcggatcttacagcggcattgtaagcggaatcgagtgggcgacgacaaacggcatggatgttatcaacatgagccttggaggaccatcaggctcaacagcgatgaaacaggcggttgacaatgcatatgcaagaggggttgtcgttgtggcggctgctgggaacagcggatcttcaggaaacacgaatacaatcggctatcctgcgaaatacgactctgtcatcgcagttggcgcggtagactctaacagcaacagagcttcattttccagcgtcggagcaaagcttgaagtcatggctcctggcgcaggcgtgtacagcacttacccaaccagcacttatgcaacattgaacggaacgtcaatggcttctcctcatgtagcgggagcagcagctttgatcttgtcaaaacatccgaacctttcagcttcacaagtccgcaaccgtctctccagtacggcgacttatttgggaagctccttctactatggaaaaggtctgatcaatgtcgaagctgccgctcaa

SEQ ID NO: 8 - protein, 350 aa, B. licheniformis
AQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPNVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSNRASFSSVGAKLEVMAPGAGVYSTYPTSTYATLNGTSMASPHVAGAAALILSKHPNLSASQVRNRLSSTATYLGSSFYYGKGLINVEAAAQ

SEQ ID NO: 9 - protein, 274 aa, B. licheniformis
AQTVPYGIPLIKADKVQAQGFKGANVKVAVLDTGIQASHPDLNVVGGASFVAGEAYNTDGNGHGTHVAGTVAALDNTTGVLGVAPNVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSNRASFSSVGAKLEVMAPGAGVYSTYPTSTYATLNGTSMASPHVAGAAALILSKHPNLSASQVRNRLSSTATYLGSSFYYGKGLINVEAAAQ

SEQ ID NO: 10 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 11 - protein, 274 aa, artificial sequence
  AprL protease variant
AQTVPYGIELIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 12 - protein, 274 aa, artificial sequence
  AprL protease variant
AQTVPYGIPLIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 13 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGTASGSTAMKQAVDNAYARGVVVVAAAGNSGSSGNTNTISYPAKYDSVIAVGAVDSNSNRASFSSVGAELEVMAPGAGVYSTYPENTYATLNGTSMASPHVAGAAALILSKHPNLSASQVRNRLSSTATYLGSSFYYGKGLINVEAAAQ

SEQ ID NO: 14 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGVVVVAAAGNSGSSGNTNTISYPAKYDSVIAVGAVDSNSNRASFSSVGAELEVMAPGAGVYSTYPTNTYATLNGTSMASPHVAGAAALILSKHPSLSASQVRNRLSSTATYLGSSFYYGKGLINVEAAAQ

SEQ ID NO: 15 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 16 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGESFYYGKGLINVEAAAQ

SEQ ID NO: 17 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGSVVVAAAGNSGSSGNTNTIGYPAKYDSVIAVGAVDSNSNRASFSSVGAELEVMAPGAGVYSTYPENTYATLNGTSMASPHVAGAAALILSKHPNLSASQVRNRLSSTATYLGSSFYYGKGLINVEAAAQ

SEQ ID NO: 18 - protein, 274 aa, artificial sequence
  AprL protease variant
AQTVPYGIELIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 19 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGESFYYGKGLINVEAAAQ

SEQ ID NO: 20 - protein, 274 aa, artificial sequence
  AprL protease variant
AQTVPYGIPLIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 21 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGTASGSTAMKQAVDNAYARGSVVVAAAGNSGSSGNTNTISYPAKYDSVIAVGAVDSNSNRASFSSVGAELEVMAPGAGVYSTYPTNTYATLNGTSMASPHVAGAAALILSKHPSLSASQVRNRLSSTATYLGSSFYYGKGLINVEAAAQ

SEQ ID NO: 22 - protein, 274 aa, artificial sequence
  AprL protease variant
AQTVPYGIPMIKADKVQAQGFKGANVRVAVLDTGIQASHPDLNVVGGASFVAGEAYNTDGNGHGTHVAGTVAALDNTTGVLGVAPSVSLYAVKVLNSHGSGSYSGIVSGIEWATTNGMDVINISLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 23 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGESFYYGKGLINVEAAAQ

SEQ ID NO: 24 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGSVVVAAAGNSGSSGNTNTISYPAKYDSVIAVGAVDSNSNRASFSSVGAELEVMAPGAGVYSTYPPNTYATLNGTSMASPHVAGAAALILSKHPNLSASQVRNRLSSTATYLGSSFYYGKGLINVEAAAQ

SEQ ID NO: 25 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGSVVVAAAGNSGSSGNTNTIGYPAKYDSVIAVGAVDSNSNRASFSSVGAELEVMAPGAGVYSTYPPNTYATLNGTSMASPHVAGAAALILSKHPNLSASQVRNRLGSTATYLGSSFYYGKGLINVEAAAQ

SEQ ID NO: 26 - protein, 274 aa, artificial sequence
  AprL protease variant
AQTVPYGIELIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 27 - protein, 274 aa, artificial sequence
  AprL protease variant
AQTVPYGIELIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGESFYYGKGLINVEAAAQ

SEQ ID NO: 28 - protein, 274 aa, artificial sequence
  AprL protease variant
AQTVPYGIELIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 29 - protein, 274 aa, artificial sequence
  AprL protease variant
AQTVPYGIPLIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 30 - protein, 274 aa, artificial sequence
  AprL protease variant
AQTVPYGIPLIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGESFYYGKGLINVEAAAQ

SEQ ID NO: 31 - protein, 274 aa, artificial sequence
  AprL protease variant
AQTVPYGIPLIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINMSLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGESFYYGKGLINVEAAAQ

SEQ ID NO: 32 - protein, 274 aa, artificial sequence
  AprL protease variant
AQTVPYGIPLIKADKVQAQGFKGANVRVAVLDTGIQASHPDLAVVGGASFVAGEAYNTDGNGHGTHVAGTVAALDNTTGVLGVAPSVSLYAVKVLNSHGSGSYSGIVSGIEWATTNGMDVINISLGGASGSTAMKQAVDNAYARGVVVVAAAGNSGSSGNTNTIGYPAKYDSVIAVGAVDSNSNRASFSSVGAELEVMAPGAGVYSTYPHNTYATLNGTSMASPHVAGAAALILSKHPNLSASQVRNRLSSTATYLGSSFYYGKGLINVEAAAQ

SEQ ID NO: 33 - protein, 274 aa, artificial sequence
  AprL protease variant
AQTVPYGIELIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGESFYYGKGLINVEAAAQ

SEQ ID NO: 34 - protein, 274 aa, artificial sequence
  AprL protease variant
AQTVPYGIELIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 35 - protein, 274 aa, artificial sequence
  AprL protease variant
AQTVPYGIELIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGESFYYGKGLINVEAAAQ

SEQ ID NO: 36 - protein, 274 aa, artificial sequence
  AprL protease variant
AQTVPYGIPLIKADKVQAQGFKGANVKVAVLDTGIQASHPDLNVRGGASFVAGEAYNTDGNGHGTHVAGTVAALDNTTGVLGVAPSVSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGESFYYGKGLINVEAAAQ

SEQ ID NO: 37 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSISGIVSGIEWATTNGMDVINMSLGTASGSTAMKQAVDNAYARGSVVVAAAGNSGSSGNTNTISYPAKYDSVIAVGAVDSNSNRASFSSVGAELEVMAPGAGVYSTYPTNTYATLNGTSMASPHVAGAAALILSKHPSLSASQVRNRLSSTATYLGSSFYYGKGLINVEAAAQ

SEQ ID NO: 38 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNHTGVLGVAPSTSLYAVKVLNSSGSGSYSGIVSGIEWATTNGMDVINISLGGASGSTAMKRAVDNAYARGVVVVAAAGNSGSSGNTNTIGYPAKYDSVIAVGAVDSNSQRASFSSVGAELEVMAPGAGVYSTYPTNTYATLNGTSMASPHVAGAAALILSKHPSLSASQVRNRLSSTATYLGSSFYYGKGLINVEAAAQ

SEQ ID NO: 39 - protein, 274 aa, artificial sequence
  AprL protease variant
AQTVPYGIPLIKADKVQAQGFKGANRKVAVLDTGIQASHPDLNVRGGASFVAGEAYNTDGNGHGTHVAGTVAALDNTTGVLGVAPSVSLYAVKVLNSRGSGSYSGIVSGIQWATTNGMDVINISLGGASGSTAMKRAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 40 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNHTGVLGVAPSTSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSQRASFSSVGAELEVMAPGAGVYSTYPTNTYATLNGTSMASPHVAGAAALILSKHPSLSASQVRNRLSSTATYLGSSFYYGKGLINVEAAAQ

SEQ ID NO: 41 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNSTGVLGVAPSSSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSNRAPFSSVGAELEVMAPGAGVYSTYPTNTYATLNGTSMASPHVAGAAALILSKHPNLSASQVRNRLSSTATYLGPSFYYGKGLINVEAAAQ

SEQ ID NO: 42 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNSTGVLGVAPSSSLYAVKVLNSSGSGSYSGIVSGIEWATTNGMDVINISLGGASGSTAMKRAVDNAYARGVVVVAAAGNSGSSGCTNTIGYPAKYDSVIAVGAVDSNSNRAPFSSVGAELEVMAPGAGVYSTYPTNTYATLNGTSMASPHVAGAAALILSKHPNLSASQVRNRLSSTATYLGPSFYYGKGLINVEAAAQ

SEQ ID NO: 43 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNHTGVLGVAPSTSLYAVKVLNSSGSGSYSGIVSGIEWATTNGMDVINISLGGASGSTAMKRAVDNAYARGVVVVAAAGNSGSSGNTNTIGYPAKYDSVIAVGAVDSNSQRAPFSSVGAELEVMAPGAGVYSTYPTNTYATLNGTSMASPHVAGAAALILSKHPSLSASQVRNRLSSTATYLGPSFYYGKGLINVEAAAQ

SEQ ID NO: 44 - protein, 274 aa, artificial sequence
  AprL protease variant
AQQVPYGIPLIKADKVQAQGFYGNNVKVAVLDTGIQASHPDLNVIGGISFVAGEAYNTDGNGHGTHVAGTVAALDNNTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLSGTSMASPHVAGAAALIISKHPNLSASQVRNRLSSTATRLGSSFYYGKGLINVEAAAQ

SEQ ID NO: 45 - protein, 274 aa, artificial sequence
  AprL protease variant
AQTVPYGIELIKADKVQAQGFKGANVKVAVLDTGIQASHPDLNVVGGASFVAGEAYNTDGNGHGTHVAGTVAALDNQTGVLGVAPSTSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPSLSASQVRNRLSSTATYLGESFYYGKGLINVEAAAQ

SEQ ID NO: 46 - protein, 274 aa, artificial sequence
  AprL protease variant
AQTVPYGIPLIKADKVQAQGFKGANVKVAVLDTGIQASHPDLAVRGGASFVAGEAYNTDGNGHGTHVAGTVAALDNHTGVLGVAPSTSLYAVKVLNSSGSGSYSGIVSGIEWATTNGMDVINISLGGASGSTAMKRAVDNAYARGVVVVAAAGNSGSSGNTNTIAYPAKYDSVIAVGAVDSNSQRAPFSSVGAELEVMAPGAGVYSTYPTNTYATLNGTSMASPHVAGAAALILSKHPSLSASQVRNRLSSTATYLGPSFYYGKGLINVEAAAQ

SEQ ID NO: 47 - protein, 274 aa, artificial sequence
  AprL protease variant
AQTVPYGIELIKADKVQAQGFKGANVKVAVLDTGIQASHPDLAVRGGASFVAGEAYNTDGNGHGTHVAGTVAALDNSTGVLGVAPSSSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSNRAPFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 48 - protein, 274 aa, artificial sequence
  AprL protease variant
AQTVPYGIELIKADKVQAQGFKGANVKVAVLDTGIQASHPDLAVRGGASFVAGEAYNTDGNGHGTHVAGTVAALDNHTGVLGVAPSTSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSQRAPFSSVGAELEVMAPGAGVYSTYPTNTYATLNGTSMASPHVAGAAALILSKHPSLSASQVRNRLSSTATYLGPSFYYGKGLINVEAAAQ

SEQ ID NO: 49 - protein, 274 aa, artificial sequence
  AprL protease variant
AQTVPYGIELIKADKVQAQGFKGANVKVAVLDTGIQASHPDLAVRGGASFVAGEAYNTDGNGHGTHVAGTVAALDNQTGVLGVAPSTSLYAVKVLNSSGSGSYSGIVSGIEWATTNGMDVINISLGGASGSTAMKRAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPSLSASQVRNRLSSTATYLGESFYYGKGLINVEAAAQ

SEQ ID NO: 50 - protein, 274 aa, artificial sequence
  AprL protease variant
AQTVPYGIELIKADKVQAQGFKGANVKVAVLDTGIQASHPDLAVRGGASFVAGEAYNTDGNGHGTHVAGTVAALDNHTGVLGVAPSTSLYAVKVLNSSGSGSYSGIVSGIEWATTNGMDVINISLGGASGSTAMKRAVDNAYARGVVVVAAAGNSGSSGNTNTIAYPAKYDSVIAVGAVDSNSQRAPFSSVGAELEVMAPGAGVYSTYPTNTYATLSGTSMASPHVAGAAALILSKHPSLSASQVRNRLSSTATYLGESFYYGKGLINVEAAAQ

SEQ ID NO: 51 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLSGTSMASPHVAGAAALIWSKHPNLSASQVRNRLSSTATYLGSSFYYGKGLINVEAAAQ

SEQ ID NO: 52 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 53 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINMSLQGASGSTAMKQAVDNAYARGVVVVAAAGNSGSSGNTNTIQYPAKYDSVIAVGAVDSNSNRASFSSVGAELEVMAPGAGVYSTYPPNTYATLSGTSMASPHVAGAAALIWSKHPNLSASQVRNRLSSTATYLGPSFYYGKGLINVEAAAQ

SEQ ID NO: 54 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINMSLGFASGSTAMKQAVDNAYARGVVVVAAAGNSGSSGNTNTIQYPAKYDSVIAVGAVDSNSNRASFSSVGAELEVMAPGVGVYSTYPPNTYATLSGTSMASPHVAGAAALIWSKHPNLSASQVRNRLSSTATYLGPSFYYGKGLINVEAAAQ

SEQ ID NO: 55 - protein, 274 aa, artificial sequence
  AprL protease variant
QQVVPYGIPLIKADKVQAQGFKGANVKAAVLDTGAQASHPDLNVVGGASFVAGEAYNTDGNGHGTHVSGTVAALDNNTGVLGVAPHVSLYAVKVLNSSGSGSYSGIVSGIEWATFNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLSGTSMASPHVAGAAALILSKHPSLSASQVRNRLGSTATYLGPSFYYGKGLINVEAAAA

SEQ ID NO: 56 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGGASGSTAMKQAVDNAYARGVVVVAAAGNSGSSGNTNTIGYPAKYDSVIAVGAVDSNSNRASFSSVGAELEVMAPGAGVYSTYPPNTYATLNGTSMASPHVAGAAALILSKHPSLSASQVRNRLGSTATYLGPSFYYGKGLINVEAAAQ

SEQ ID NO: 57 - protein, 274 aa, artificial sequence
  AprL protease variant
AQTVPYGIPLIKADKVQAQGFKGANVKVAVLDTGIQASHPDLNVIGGASFVAGEAYNTDGNGHGTHVSGTVAALDNNTGVLGVAPSVSLYAVKVLNSSGSGSYSGIVSGIEWATTNGMDVINISNGGASGSTAMKQAVDNAYARGVVVVAAAGNSGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 58 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTAAALDNNTGVLGVAPSVSLYAVKVANSSGSGSYSGIVSGIEWATTNGMDVINMSLGGASGSTAMKQAVDNAYARGVVVVAAAGNSGSSGNTNTIQYPAKYDSVIAVGAVDSNSQRASFSSVGAELEVMAPGAGVYSTYPPNTYATLNGTSMASPHVAGAAALILSKHPNLSASQVRNRLSSTATYLGPSFYYGKGLINVEAAAQ

SEQ ID NO: 59 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGVVVVAAAGNSGSSGNTNTIGYPAKYDSVIAVGAVDSNSNRASFSSVGAELEVMAPGAGVYSTYPPNTYATLSGTSMASPHVAGAAALILSKHPNLSASQVRNRLSSTATYLGPSFYYGKGLINVEAAAQ

SEQ ID NO: 60 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGFASGSTAMKQAVDNAYARGVVVVAAAGNSGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 61 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 62 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNSTGVLGVAPSVSLYAVKVLNSSGSGSYSGIVSGIEWATTNGMDVINMSLGGASGSTAMKQAVDNAYARGVVVVAAAGNSGSSGNTNTIAYPAKYDSVIAVGAVDSNSQRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 63 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 64 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTAAALDNSTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSQRASFSSVGAELEVMAPGAGVYSTYPTNTYATLNGTSMASPHVAGAAALILSKHPNLSASQVRNRLSSTATYLGPSFYYGKGLINVEAAAQ

SEQ ID NO: 65 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGGASGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 66 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTAAALDNTTGVLGVAPSVSLYAVKVANSSGSGSYSGIVSGIEWATTNGMDVINMSLGGSSGSTAMKQAVDNAYARGVVVVAAAGNSGSSGNTNTIGYPAKYDSVIAVGAVDSNSNRASFSSVGAELEVMAPGAGVYSTYPPNTYATLNGTSMASPHVAGAAALILSKHPNLSASQVRNRLSSTATYLGSSFYYGKGLINVEAAAQ

SEQ ID NO: 67 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTAAALDNTTGVLGVAPSVSLYAVKVLNSSGSGSYSGIVSGIEWATTNGMDVINISLGGSSGSTAMKQAVDNAYARGVVVVAAAGNSGSSGNTNTIGYPAKYDSVIAVGAVDSNSNRASFSSVGAELEVMAPGAGVYSTYPPNTYATLNGTSMASPHVAGAAALILSKHPNLSASQVRNRLSSTATYLGSSFYYGKGLINVEAAAQ

SEQ ID NO: 68 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTAAALDNTTGVLGVAPSVSLYAVKVLNSSGSGSYSGIVSGIEWATTNGMDVINISLGGSSGSTAMKQAVDNAYARGVVVVAAAGNSGSSGNTNTIEYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 69 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNSTGVLGVAPSVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSQRASFSSVGAELEVMAPGAGVYSTYPTNTYATLSGTSMASPHVAGAAALILSKHPNLSASQVRNRLSSTATYLGSSWYYGKGLINVEAAAQ

SEQ ID NO: 70 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNHTGVLGVAPSVSLYAVKVLNSSGSGSYSGIVSGIEWATTNGMDVINMSLGGSSGSTAMKQAVDNAYARGVVVVAAAGNSGSSGNTNTIQYPAKYDSVIAVGAVDSNSNRASFSSVGAELEVMAPGAGVYSTYPPNTYATLNGTSMASPHVAGAAALILSKHPNLSASQVRNRLSSTATYLGSSFYYGKGLINVEAAAQ

SEQ ID NO: 71 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNDTGVLGVAPRVSLYAVKVLNSSGSGSYSGIVSGIEWATTNGMDVINMSLGGASGSTAMKQAVDNAYARGVVVVAAAGNEGSSGNTNTIAYPAKYDSVIAVGAVDSNSQRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 72 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTAAALDNNTGVLGVAPSVSLYAVKVLNSSGSGSYSGIVSGIEWATTNGMDVINMSLGGSSGSTAMKQAVDNAYARGVVVVAAAGNSGSSGNTNTIQYPAKYDSVIAVGAVDSNSNRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 73 - protein, 274 aa, artificial sequence
  AprL protease variant
AQTVPYGIPLIKADKVQAQGFKGANVKAAVLDTGAQASHPDLNVVGGASFVAGEAYNTDGNGHGTHVSGTVAALDNNTGVLGVAPSVSLYAVKVLNSSGSGSYSGIVSGIEWATTNGMDVINMSLGGSSGSTAMKQAVDNAYARGVVVVAAAGNSGSSGNTNTIQYPAKYDSVIAVGAVDSNSQRASFSSVGAELEVMAPGANVYSTYPPNTYATLNGTSMASPHVAGAAALILSKHPNLSASQVRNRLSSTATYLGSSFYYGKGLINVEAAAQ

SEQ ID NO: 74 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPPNTYATLNGTSMASPHVAGAAALILSKHPNLSASQVRNRLSSTATYLGSSFYYGKGLINVEAAAQ

SEQ ID NO: 75 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPPNTYATLNGTSMASPHVAGAAALILSKHPNLSASQVRNRLSSTATYLGPSFYYGKGLINVEAAAQ

SEQ ID NO: 76 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPPNTYATLNGTSMASPHVAGAAALILSKHPNLSASQVRNRLSSTATYLGSPFYYGKGLINVEAAAQ

SEQ ID NO: 77 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSNRAPFSSVGAELEVMAPGAGVYSTYPPNTYATLNGTSMASPHVAGAAALILSKHPNLSASQVRNRLSSTATYLGSSFYYGKGLINVEAAAQ

SEQ ID NO: 78 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSNRAPFSSVGAELEVMAPGAGVYSTYPPNTYATLNGTSMASPHVAGAAALILSKHPNLSASQVRNRLSSTATYLGPSFYYGKGLINVEAAAQ

SEQ ID NO: 79 - protein, 274 aa, artificial sequence
  AprL protease variant
AQTVPYGIELIKADKVQAQGFKGANVKVAVLDTGIQASHPDLNVVGGASFVAGEAYNTDGNGHGTHVAGTVAALDNSTGVLGVAPSTSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPPNTYATLNGTSMASPHVAGAAALILSKHPKLSASQVRNRLSSTATYLGSSFYYGKGLINVEAAAQ

SEQ ID NO: 80 - protein, 274 aa, artificial sequence
  AprL protease variant
AQTVPYGIPLIKADIVQAQGFKGANVKVAVLDTGIQASHPDLNVVGGASFVAGEAYNTDGNGHGTHVAGTVAALDNTTGVLGVAPSVSLYAVKVQNSSGSGSYSGIVSGIEWATTNGMDVINISLGGASGSTAMKQAVDNAYARGVVVVAAAGNSGSSGNTNTISYPAKYDSVIAVGAVDSNSNRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 81 - protein, 274 aa, artificial sequence
  AprL protease variant
AQTVPYGIPLIKADIVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGSVVVAAAGNSGSSGNTNTISYPAKYDSVIAVGAVDSNSNRASFSSVGAELEVMAPGAGVYSTYPPNTYATLNGTSMASPHVAGAAALILSKHPSLSASQVRNRLSSTATYLGSSFYYGKGLINVEAAAQ

SEQ ID NO: 82 - protein, 274 aa, artificial sequence
  AprL protease variant
AQTVPYGIPLIKADIVQAQGFKGANVKVAVLDTGIQASHPDLNVVGGASFVAGEAYNTDGNGHGTHVAGTVAALDKTTGVLGVAPSVSLYAVKVLNSSGSGSYSGIVSGIEWATTNGMDVINISLGGASGSTAMKQAVDNAYARGSVVVAAAGNSGSSGNTNTISYPAKYDSVIAVGAVDSNSNRASFSSVGAELEVMAPGAGVYSTYPPNTYATLNGTSMASPHVAGAAALILSKHPSLSASQVRNRLSSTATYLGSSFYYGKGLINVEAAAQ

SEQ ID NO: 83 - protein, 274 aa, artificial sequence
  AprL protease variant
AQTVPYGIPLIKADIVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGSVVVAAAGNSGSSGNTNTISYPAKYDSVIAVGAVDSNSNRASFSSVGAELEVMAPGAGVYSTYPPNTYATLNGTSMASPHVAGAAALILSKHPSLSASQVRNRLSSTATYLGSSFYYGKGLINVEAAAQ

SEQ ID NO: 84 - protein, 274 aa, artificial sequence
  AprL protease variant
AQTVPYGIELIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGSVVVAAAGNSGSSGNTNTIGYPAKYDSVIAVGAVDSNSQRASFSSVGAELEVMAPGAEVYSTYPPNTYATLNGTSMASPHVAGAAALILSKHRSLSASQVRNRLSSTATYLGSSFYYGKGLINVEAAAQ

SEQ ID NO: 85 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGVVVVAAAGNSGSSGNTNTISYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 86 - protein, 274 aa, artificial sequence
  AprL protease variant
AQTVPYGIPLIKADIVQAQGFKGANVKVAVLDTGIQASHPDLNVVGGASFVAGEAYNTDGNGHGTHVAGTVAALDNTTGVLGVAPSVSLYAVKVQNSSGSGSYSGIVKGIEWATTNGMDVINMSLGGASGSTAMKQAVDNAYARGVVVVAAAGNSGSSGNTNTISYPAKYDSVIAVGAVDSNSNRASFSSVGAELEVMAPGAEVYSTYPPNTYATLSGTSMASPHVAGAAALILSKHPNLSASQVRNRLSSTATYLGSSFYYGKGLINVEAAAQ

SEQ ID NO: 87 - protein, 274 aa, artificial sequence
  AprL protease variant
AQTVPYGIPLIKADIVQAQGFKGANVKVAVLDTGIQASHPDLNVVGGASFVAGEAYNTDGNGHGTHVAGTVAALDNTTGVLGVAPSVSLYAVKVQNSSGSGSYSGIVKGIEWATTNGMDVINMSLGGASGSTAMKQAVDNAYARGVVVVAAAGNSGSSGNTNTISYPAKYDSVIAVGAVDSNSNRASFSSVGAELEVMAPGAEVYSTYPPNTYATLNGTSMASPHVAGAAALILSKHPNLSASQVRNRLSSTATYLGSSFYYGKGLINVEAAAQ

SEQ ID NO: 88 - protein, 274 aa, artificial sequence
  AprL protease variant
AQTVPYGIELIKADIVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTISYPAKYDSVIAVGAVDSNSNRASFSSVGDELEVMAPGAEVYSTYPPNTYATLNGTSMASPHVAGAAALILSKHPNLSASQVRNRLSSTATYLGSSFYYGKGLINVEAAAQ

SEQ ID NO: 89 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGGASGSTAMKQAVDNAYARGVVVVAAAGNSGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 90 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNHTGVLGVAPSVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 91 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 92 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTAAALDNNTGVLGVAPSVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 93 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSSSLYAVKVLNSSGSGSYSGIVSGIEWATTNGMDVINISLGGASGSTAMKQAVDNAYARGVVVVAAAGNGGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 94 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNHTGVLGVAPSSSLYAVKVLNSSGSGSYSGIVSGIEWATTNGMDVINMSLGGASGSTAMKQAVDNAYARGVVVVAAAGNGGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 95 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSSSLYAVKVLNSSGSGSYSGIVSGIEWATTNGMDVINMSLGGASGSTAMKQAVDNAYARGVVVVAAAGNGGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 96 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGGASGSTAMKQAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 97 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 98 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTAAALDNNTGVLGVAPSVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 99 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSSSLYAVKVLNSSGSGSYSGIVSGIEWATTNGMDVINISLGGASGSTAMKQAVDNAYARGVVVVAAAGNGGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 100 - protein, 274 aa, artificial sequence
  AprL protease variant
AQTVPYGIPLIKADKVQAQGFKGANVKVAVLDTGAQASHPDLNVVGGASFVAGEAYNTDGNGHGTHVSGTVAALDNNTGVLGVAPSSSLYAVKVLNSSGSGSYSGIVSGIEWATTNGMDVINMSLGGASGSTAMKQAVDNAYARGVLVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 101 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSSSLYAVKVLNSSGSGSYSGIVSGIEWATTNGMDVINMSLGGASGSTAMKQAVDNAYARGVLVVAAAGNEGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 102 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSSSLYAVKVLNSSGSGSYSGIVSGIEWATTNGMDVINISLGGASGSTAMKQAVDNAYARGVLVVAAAGNGGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 103 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGASGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 104 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 105 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTAAALDNNTGVLGVAPSVSLYAVKVLNSSGNGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPPNTYATLSGTSMASPHVAGAAALILSKHPTLSASQVRNRLSSTATYLGSSFYYGKGLINVEAAAQ

SEQ ID NO: 106 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 107 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNTTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 108 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 109 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 110 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 111 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 112 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINISLGGASGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 113 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 114 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGGASGSTAMKQAVDNAYARGVVVVAAAGNSGSSGNTNTIGYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 115 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGGASGSTAMKQAVDNAYARGVVVVAAAGNSGSSGNTNTIQYPAKYDSVIAVGAVDSNSQRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 116 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 117 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 118 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGGASGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 119 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVHGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 120 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSSSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 121 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWANTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 122 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 123 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGTPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 124 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 125 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSSSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 126 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSSSGSYSGIVSGIEWATTNGMDVINMSLGTPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 127 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSSSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 128 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWANTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 129 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWANTNGMDVINMSLGTPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 130 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWANTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 131 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGTPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 132 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 133 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGTPSGSTAMKQAVDNAYARGVVVVAAAGNSGSSGNTNTIQYPAKYDSVIAVGAVDSNSQRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 134 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSSSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 135 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGTPSGSTAMKQAVDNAYARGVVVVAAAGNSGSSGNTNTIQYPAKYDSVIAVGAVDSNSQRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 136 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSSSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 137 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWANTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 138 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGTPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 139 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPPNTYATLSGTSMASPHVAGAAALILSKHPNLSASQVRNRLSSTATYLGSSFYYGKGLINVEAAAQ

SEQ ID NO: 140 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPHVSLYAVKVLNSSGSGSYSGIVSGIEWATFNGMDVINMSLGGASGSTAMKQAVDNAYVRGVVVVAAAGNSGSSGNTNTIQYPAKYDSVIAVGAVDSNSNRASFSSVGAELEVMAPGVGVYSTYPTNTYATLNGTSMASPHVAGAAALILSKHPNLSASQVRNRLSSTATYLGPSFYYGKGLINVEAAAQ

SEQ ID NO: 141 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPHVSLYAVKVANSSGSGSYSGIVSGIEWATTNGMDVINMSLGGASGSTAMKQAVDNAYARGVVVVAAAGNSGSSGNTNTIGYPAKYDSVIAVGAVDSNSQRASFSSVGAELEVMAPGVGVYSTYPPNTYATLSGTSMASPHVAGAAALIWSKHPNLSASQVRNRLGSTATYLGPSFYYGKGLINVEAAAQ

SEQ ID NO: 142 - protein, 274 aa, artificial sequence
  AprL protease variant
AQTVPYGIPLIKADKVQAQGFKGANVKVATLDTGAQASHPDLNVVGGASFVAGEAYNTDGNGHGTHVAGTVAALDNNTGVLGVAPSVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSNRASFSSVGAELEVMAPGVGVYSTYPPNTYATLNGTSMASPHVAGAAALILSKHPNLSASQVRNRLGSTATYLGPSFYYGKGLINVEAAAQ

SEQ ID NO: 143 - protein, 274 aa, artificial sequence
  AprL protease variant
QQVVPYGIPLIKADKVQAQGFKGANVKVAVLDTGAQASHPDLNVVGGASFVAGEAYNTDGNGHGTHVAGTVAALDNNIGVLGVAPHVSLYAVKVLNSSGSGSYSGIVSGIEWATFNGMDVINMSLGGASGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALIWSKHPNLSASQVRNRLSSTATYLGPSFYYGKGLINVEAAAQ

SEQ ID NO: 144 - protein, 274 aa, artificial sequence
  AprL protease variant
QQTVPYGIPLIKADKVQAQGFKGANVKVAVLDTGIQTSHPDLNVVGGASFVAGEAYNTDGNGHGTHVAGTVAALDNNIGVLGVAPHVSLYAVKVLNSSGSGSYSGIVSGIEWATTNGMDVINISLGGASGSTAMKQAVDNAYARGVVVVAAAGNSGSSGNTNTIQYPAKYDSVIAVGAVDSNSQRASFSSVGAELEVMAPGVGVYSTYPTNTYATLNGTSMASPHVAGAAALILSKHPSLSASQVRNRLGSTATYLGPSFYYGKGLINVEAAAA

SEQ ID NO: 145 - protein, 274 aa, artificial sequence
  AprL protease variant
AQTVPYGIELIKADKVQAQGFKGANVKVAVLDTGIQASHPDLNVVGGASFVAGEAYNTDGNGHGTHVAGTVAALDNNTGVLGVAPSVSLYAVKVLSSSGSGSYSGIVSGIEWATTNGMDVINMSLGGASGSTAMKQAVDNAYARGVVVVAAAGNSGSSGNTNTIQYPAKYDSVIAVGAVDSNSNRASFSSVGAELEVMAPGAEVYSTYPTNTYATLNGTSMASPHVAGAAALILSKHPNLSASQVRNRLGSTATYLGSSFYYGKGLINVEAAAQ

SEQ ID NO: 146 - protein, 274 aa, artificial sequence
  AprL protease variant
AQTVPYGIELIKADKVQAQGFKGANVKVAVLDTGIQASHPDLNVVGGASFVAGEAYNTDGNGHGTHVAGTVAALDNNTGVLGVAPSVSLYAVKVLSSSGSGSYSGIVSGIEWATTNGMDVINMSLGGASGSTAMKQAVDNAYARGVVVVAAAGNSGSSGNTNTIEYPAKYDSVIAVGAVDSNSNRASFSSVGAELEVMAPGAEVYSTYPPNTYATLNGTSMASPHVAGAAALILSKHPNLSASQVRNRLGSTATYLGSSFYYGKGLINVEAAAQ

SEQ ID NO: 147 - protein, 274 aa, artificial sequence
  AprL protease variant
QQVVPYGIPLIKADKVQAQGFKGANVKVAVLDTGIQASHPDLNVVGGASFVAGEAYNTDGNGHGTHVAGTVAALDNTTGVLGVAPHVSLYAVKVLNSSGSGSYSGIVSGIEWATTNGMDVINMSLGGASSSTAMKQAVDNAYARGVVVVAAAGNGGSSGNTNTIQYPAKYDSVIAVGAVDSNSQRASFSSVGAELEVMAPGVNVYSTYPPNTYATLNGTSMASPHVAGAAALILSKHPNLSASQVRNRLSSTATYLGSSFYYGKGLINVEAAAA

SEQ ID NO: 148 - protein, 274 aa, artificial sequence
  AprL protease variant
QQVVPYGIPLIKADKVQAQGFKGANVKVAVLDTGIQASHPDLNVVGGASFVAGEAYNTDGNGHGTHVAGTVAALDNTTGVLGVAPHVSLYAVKVLNSSGSGSYSGIVSGIEWATTNGMDVINMSLGGASGSTAMKQAVDNAYARGVVVVAAAGNSGSSGNTNTIQYPAKYDSVIAVGAVDSNSQRASFSSVGAELEVMAPGAGVYSTYPTNTYATLNGTSMASPHVAGAAALILSKHPSLSASQVRNRLGSTATYLGPSFYYGKGLINVEAAAQ

SEQ ID NO: 149 - protein, 274 aa, artificial sequence
  AprL protease variant
QQTVPYGIPLIKADKVQAQGFKGANVKVAVLDTGIQASHPDLNVVGGASFVAGEAYNTDGNGHGTHVAGTVAALDNNTGVLGVAPHVSLYAVKVLNSSGSGSYSGIVSGIEWATTNGMDVINMSLGGASGSTAMKQAVDNAYARGVLVVAGAGNSGSSGNTNTIGYPAKYDSVIAVGAVDSNSQRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 150 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPHVSLYAVKVLNSSGSGSYSGIVSGIEWATFNGMDVINMSLGGASGSTAMKQAVDNAYARGVVVVAAAGNGGSSGNTNTIQYPAKYDSVIAVGAVDSNSQRASFSSVGAELEVMAPGVGVYSTYPTNTYATLNGTSMASPHVAGAAALILSKHPNLSASQVRNRLSSTATYLGSSFYYGKGLINVEAAAA

SEQ ID NO: 151 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNTTGVLGVAPHVSLYAVKVLNSSGSGSYSGIVSGIEWATFNGMDVINMSLGGASGSTAMKQAVDNAYARGVVVVAAAGNSGSSGNTNTIGYPAKYDSVIAVGAVDSNSQRASFSSVGAELEVMAPGVNVYSTYPTNTYATLNGTSMASPHVAGAAALILSKHPSLSASQVRNRLGSTATYLGPSFYYGKGLINVEAAAA

SEQ ID NO: 152 - protein, 274 aa, artificial sequence; identical to SEQ ID NO: 110
  AprL protease variant

SEQ ID NO: 153 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSSSLYAVKVLNSSGSGSYSGIVSGIEWATTNGMDVINMSLGGPSGSTAMKQAVDNAYARGVVVVAAAGNGGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 154 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 155 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSSSLYAVKVLNSSGSGSYSGIVSGIEWATTNGMDVINMSLGGPSGSTAMKQAVDNAYARGVVVVAAAGNGGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 156 - protein, 274 aa, artificial sequence
  AprL protease variant
AQTVPYGIPLIKADKVQAQGFKGANVKVAVLDTGAQASHPDLNVVGGASFVAGEAYNTDGNGHGTHVSGTVAALDNNTGVLGVAPSSSLYAVKVLNSSGSGSYSGIVSGIEWATTNGMDVINMSLGGPSGSTAMKQAVDNAYARGVLVVAAAGNSGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 157 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSSSLYAVKVLNSSGSGSYSGIVSGIEWATTNGMDVINMSLGGPSGSTAMKQAVDNAYARGVVVVAAAGNGGSSGNTNTIQYPAKYDSVIAVGAVDSNSNRASFSSVGAELEVMAPGAGVYSTYPTNTYATLSGTSMASPHVAGAAALILSKHPNLSGSQVRNRLSSTATYLGSSFYYGKGLINVEAAAQ

SEQ ID NO: 158 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSSSLYAVKVLNSSGSGSYSGIVSGIEWATTNGMDVINMSLGGPSGSTAMKQAVDNAYARGVLVVAAAGNEGSSGNTNTIQYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 159 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSSSLYAVKVLNSSGSGSYSGIVSGIEWATTNGMDVINMSLGGPSGSTAMKQAVDNAYARGVVVVAAAGNEGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 160 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPNSSLYAVKVLNSSGSGSYSGIVSGIEWATTNGMDVINMSLGGPSGSTAMKQAVDNAYARGVVVVAAAGNGGSSGNTNTIQYPAKYDSVIAVGAVDSNSNRASFSSVGAELEVMAPGAGVYSTYPTNTYATLSGTSMASPHVAGAAALILSKHPNLSGSQVRNRLSSTATYLGSSFYYGKGLINVEAAAQ

SEQ ID NO: 161 - protein, 274 aa, artificial sequence
  AprL protease variant
AQTVPYGIPLIKADKVQAQGFKGANVKVAVLDTGAQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVLVVAAAGNSGSSGNTNTIQYPAKYDSVIAVGAVDSNSNRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 162 - protein, 274 aa, artificial sequence
  AprL protease variant
AQTVPYGIPLIKADKVQAQGFKGANVKVAVLDTGAQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNGGSSGNTNTIQYPAKYDSVIAVGAVDSNSNRASFSSVGAELEVMAPGAGVYSTYPTNTYATLNGTSMASPHVAGAAALILSKHPNLSGSQVRNRLSSTATYLGSSFYYGKGLINVEAAAQ

SEQ ID NO: 163 - protein, 274 aa, artificial sequence
  AprL protease variant
AQTVPYGIPLIKADKVQAQGFKGANVKVAVLDTGAQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVLVVAAAGNSGSSGNTNTIQYPAKYDSVIAVGAVDSNSNRASFSSVGAELEVMAPGAGVYSTYPTNTYATLNGTSMASPHVAGAAALILSKHPNLSGSQVRNRLSSTATYLGSSFYYGKGLINVEAAAQ

SEQ ID NO: 164 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSSSLYAVKVLNSSGSGSYSGIVSGIEWATTNGMDVINMSLGGPSGSTAMKQAVDNAYARGVVVVAAAGNGGSSGNTNTIQYPAKYDSVIAVGAVDSNSNRASFSSVGAELEVMAPGAGVYSTYPTNTYATLNGTSMASPHVAGAAALILSKHPNLSGSQVRNRLSSTATYLGSSFYYGKGLINVEAAAQ

SEQ ID NO: 165 - DNA, 867 bp, S. aureus
cccagctctatcacaaacgaaaattggataaagtgggatatttttaaaatatatatttatgttacagtaatattgacttttaaaaaaggattgattctaatgaagaaagcagacaagtaagcctcctaaattcactttagataaaaatttaggaggcatatcaaatgaactttaataaaattgatttagacaattggaagagaaaagagatatttaatcattatttgaaccaacaaacgacttttagtataaccacagaaattgatattagtgttttataccgaaacataaaacaagaaggatataaattttaccctgcatttattttcttagtgacaagggtgataaactcaaatacagcttttagaactggttacaatagcgacggagagttaggttattgggataagttagagccactttatacaatttttgatggtgtatctaaaacattctctggtatttggactcctgtaaagaatgacttcaaagagttttatgatttatacctttctgatgtagagaaatataatggttcggggaaattgtttcccaaaacacctatacctgaaaatgctttttctctttctattattccatggacttcatttactgggtttaacttaaatatcaataataatagtaattaccttctacccattattacagcaggaaaattcattaataaaggtaattcaatatatttaccgctatctttacaggtacatcattctgtttgtgatggttatcatgcaggattgtttatgaactctattcaggaattgtcagataggcctaatgactggcttttataatatgagataatgccgactgtactttttacagtcggttttctaatgtcactaa

SEQ ID NO: 166 - protein, 3 aa, artificial sequence
  YNT motif
YNT

SEQ ID NO: 167 - protein, 3 aa, artificial sequence
  Motif 2 wherein the amino acid positions are numbered by correspondence with the amino acid sequence of SEQ ID NO:2
  MISC_FEATURE (1)..(3): the amino acid positions are numbered by correspondence with the amino acid sequence of SEQ ID NO:2
YNT

SEQ ID NO: 168 - protein, 10 aa, artificial sequence
  motif3
  MISC_FEATURE (3)..(3): X is A or S
  MISC_FEATURE (6)..(6): X is absent or any amino acid
  MISC_FEATURE (7)..(7): X is A or S
FVXGEXXYNT

SEQ ID NO: 169 - protein, 9 aa, artificial sequence
  Motif 4
  MISC_FEATURE (1)..(9): the amino acid positions are numbered by correspondence with the amino acid sequence of SEQ ID NO:2
  MISC_FEATURE (3)..(3): X is A or S
  MISC_FEATURE (6)..(6): X is A or S
FVXGEXYNT

SEQ ID NO: 170 - protein, 4 aa, artificial sequence
  Motif 5
  MISC_FEATURE (3)..(3): X is A or G
LSXS

SEQ ID NO: 171 - protein, 4 aa, artificial sequence
  Motif 6
LSAS

SEQ ID NO: 172 - protein, 4 aa, artificial sequence
  Motif 7
LSGS

SEQ ID NO: 173 - protein, 4 aa, artificial sequence
  Motif 8
  MISC_FEATURE (1)..(4): the amino acid positions are numbered by correspondence with the amino acid sequence of SEQ ID NO:2
LSAS

SEQ ID NO: 174 - protein, 4 aa, artificial sequence
  Motif 9
  misc_feature (1)..(4): the amino acid positions are numbered by correspondence with the amino acid sequence of SEQ ID NO:2
LSGS

SEQ ID NO: 175 - protein, 11 aa, artificial sequence
  Motif 10
  MISC_FEATURE (2)..(4): X is any amino acid
  MISC_FEATURE (7)..(7): X is A or G
  MISC_FEATURE (10)..(10): X is I or V
KXXXLSXSQXR

SEQ ID NO: 176 - protein, 11 aa, artificial sequence
  Motif 11
  MISC_FEATURE (2)..(4): X is any amino acid
  MISC_FEATURE (10)..(10): X is I or V
KXXXLSASQXR

SEQ ID NO: 177 - protein, 11 aa, artificial sequence
  Motif 12
  MISC_FEATURE (2)..(4): X is any amino acid
  MISC_FEATURE (10)..(10): X is I or V
KXXXLSGSQXR

SEQ ID NO: 178 - protein, 11 aa, artificial sequence
  Motif 13
  MISC_FEATURE (1)..(11): The amino acid positions are numbered by correspondence with the amino acid sequence of SEQ ID NO:2
  MISC_FEATURE (2)..(4): X is any amino acid
  MISC_FEATURE (10)..(10): X is I or V
KXXXLSASQXR

SEQ ID NO: 179 - protein, 11 aa, artificial sequence
  Motif 14
  MISC_FEATURE (1)..(11): the amino acid positions are numbered by correspondence with the amino acid sequence of SEQ ID NO:2
  MISC_FEATURE (2)..(4): X is any amino acid
  MISC_FEATURE (10)..(10): X is I or V
KXXXLSGSQXR

SEQ ID NO: 180 - protein, 275 aa, B. licheniformis
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGGVYSTYPTNTYATLNGTSMASPHVAGAAALILSKHPNLSASQVRNRLSSTATYLGSSFYYGKGLINVEAAAQ

SEQ ID NO: 181 - protein, 274 aa, unknown
  Bacillus sp.
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYAKGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 182 - protein, 274 aa, B. licheniformis
AQTVPYGIPLIKADKVQAQGYKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 183 - protein, 274 aa, B. licheniformis
AQTVPYGIPLIKADKVQAQGFKGANVKVAVLDTGIQASHPDLNVVGGASFVASEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 184 - protein, 274 aa, B. licheniformis
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYAKGVVVVAAAGNSGSSGNTNTIGYPAKYDSVIAVGAVDSNGNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 185 - protein, 274 aa, B. licheniformis
AQTVPYGIPLIKADKVQAQGFKGANVKVAVLDTGIQASHPDLNVVGGASFVAGEAYNTDGNGHGTHVAGTVAALDNTTGVLGVAPNVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 186 - protein, 274 aa, B. licheniformis
AQTVPYGIPLIKADKVQAQGYKGANVKVAVLDTGIQASHPDLNVVGGASFVAGEAYNTDGNGHGTHVAGTVAALDNTTGVLGVAPNVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTSTYATLNGTSMASPHVAGAAALILSKHPNLSASQVRNRLSSTATYLGSSFYYGKGLINVEAAAQ

SEQ ID NO: 187 - protein, 274 aa, B. licheniformis
AQTVPYGIPLIKADKVQAQGFKGANVKVAVLDTGIQASHPDLNVVDGASFVAGEAYNTDGHGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVEAELEVMAPGAGVYSTYPTNTYATLNGTSMASPHVAGAAALILSKHPNLSASQVRNRLSSTATYLGSSFYYGKGLINVEAAAQ

SEQ ID NO: 188 - protein, 274 aa, B. licheniformis
AQTVPYGIPLIKADKVQAQGYKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYAKGVVVVAAAGNSGSSGNANTIGYPAKYDSVIAVGAVDSNSNRASFSSVGAELEVMAPGASVYSTYPTSTYATLNGTSMASPHVAGAAALILSKHPNLSASQVRNRLSSTATYLGSSFYYGKGLINVEAAAQ

SEQ ID NO: 189 - protein, 274 aa, B. licheniformis
AQTVPYGIPLIKADKLHAQGFKGANVKGAVLATGIPTSHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYAKGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 190 - protein, 274 aa, B. licheniformis
GQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWVTTNGMDVINMSLGGASGSTAMKQAVDNAYARGVVVVAAAGNSGSSGNTNTIGYPAKCDSVIPVGGEDSNSNRSSFSSVGAELEVMAPVSGVYSTYPTNTYTTLNGTSMASPHVAGTSALILSKHPNLSASQVRNRLSRTATYLGSSFYYGKGLINVEAAAQ

SEQ ID NO: 191 - protein, 274 aa, unknown
  Bacillus sp. GO-13
AQTVPYGIPQIKADKVQAQGYKGANVKVGVLDTGIAASHSDLNVVGGASFVSGESYNTDGNGHGTHVAGTVAALDNSIGVLGVAPNVSLYAIKVLNSSGSGTYSAIVSGIEWATANNLDVINMSLGGPSGSTALKQAVDKAYASGVVVVAAAGNSGTSGSSSTIGYPAKYDSVIAVGAVNSSNQRASFSSVGPELDVVAPGVSIYSTYPSNTYATLNGTSMASPHVAGAAALILSKSPALSASQVRDRLSSTATNLGDSFYYGKGLINVEAAAQ

SEQ ID NO: 192 - protein, 275 aa, unknown
  Bacillus sp. NSP9.1
AQTVPYGIPLIKADKVQAQGFKGANVKVGVIDTGIQSSHSDLNVSGGASFVSGDSNPFIDGNGHGTHVAGTVAALDNSIGVLGVAPNVSLYAIKVLNSSGSGTYSAIVSGIEWATSNGMDVINMSLGGSSGSTALKQAVDNAYARGVVVVAAAGNSGSSGSSNTIGYPAKYDSVIAVGAVDSNSNRASYSSVGSELEVMAPGSGVYSTYPSNTYATLNGTSMASPHVAGAAALILSKYPTLSASQVRNRLSSTATYLGSSFYYGNGLINVEAAAQ

SEQ ID NO: 193 - protein, 274 aa, unknown
  Bacillus sp. TH008
AQTVPYGIPQIKADKVQAQGYKGANVKVGVIDTGIAASHSDLNVVGGASFVSGESYNTDGNGHGTHVAGTVAALDNSIGVLGVAPNVSLYAIKVLNSSGSGTYSAIVSGIEWATANNLDVINMSLGGTSGSTALKQAVDKAYASGVVVVAAAGNSGTSGSSSTIGYPAKYDSVIAVGAVNSSNQRASFSSVGPELDVVAPGVSIYSTYPSNTYATLNGTSMASPHVAGAAALILSKYPTLSASQVRDRLSSTATNLGDSFYYGKGLINVEAAAQ

SEQ ID NO: 194 - protein, 274 aa, B. licheniformis
AQTVPYGVPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 195 - protein, 274 aa, B. licheniformis
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMVSPHVAGAAALILSKHPNLSASQVRNRLSSTATYLGSSFYYGKGLINVEAAAQ

SEQ ID NO: 196 - protein, 274 aa, B. licheniformis [sequence omitted]

SEQ ID NO: 197 - protein, 274 aa, B. licheniformis
AQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGTYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPTSTYATLNGTSMASPHVAGAAALILSKHPNLSASQVRNRLSSTATYLGSSFYYGKGLINVEAAAQ

SEQ ID NO: 198 - protein, 274 aa, B. licheniformis
AQTVPYGIPLIKADKVQAQGYKGANVKVAVLDTGIQASHPDLNVVGGASFVAGEAYNTDGNGHGTHVAGTVAALDNTTGVLGVAPNVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPTSTYATLNGTSMASPHVAGAAALILSKHPNLSASQVRNRLSSTATYLGSSFYYGKGLINVEAAAQ

SEQ ID NO: 199 - protein, 274 aa, B. licheniformis
AQTVPYGIPLIKADKVQAQGYKGANVKVAVLDTGIQASHPDLNVVGGASFVAGEAYNTDGNGHGTHVAGTVAALDNTTGVLGVAPNVSLYAVKVLNSSGSGSYSGIVSGIEWATTNGMDVINMSLGGPSGSTAMKQAVDNAYARGVVVVAAAGNSGSSGNTNTIGYPAKYDSVIAVGAVDPNSNRASFSSVGAELEVMAPGAGVYSTYPTSTYATLNGTSMASPHVAGAAALILSKHPNLSASQVRNRLSSTATYLGSSFYYGKGLINVEAAAQ

SEQ ID NO: 200 - protein, 274 aa, B. licheniformis
GQTVPYGIPLIKADKVQAQGFKGANVKVAVLDTGIQASHPDLNVVGGASFVAGEAYNTDGNGHGTHVAGTVAALDNTTGVLGVAPSVSLFAVKVLNSSGSGSYSGIVSGIEWATTNGMDVINMSLGGPSGSTAMKQAVDNAYSKGVVPVAAAGNSGSSGYTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 201 - protein, 273 aa, B. licheniformis
GQTVPYGIPLIKADKVQAQGFKGANVKVAVLDTGIQASHPDLNVVGGASFVAGEAYNTDGNGHGTHVAGTVAALDNTTGLGVAPSVSLFAVKVLNSSGSGSYSGIVSGIEWATTNGMDVINMSLGGPSGSTAMKQAVDNAYSKGVVPVAAAGNSGSSGYTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

SEQ ID NO: 202 - protein, 274 aa, B. licheniformis
GQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSAIVSGIEWATTTGMDVINMSLGGASVSTAMKQAVDHAYARGAVVVSSAGNSGSSGNTNTIGYPAKYDSVIAVGAVDSNSNRASFSSVGAELEVMAPGAGVYSTYPTNTYATLNGTSMASPHVAGAAALILSKHPNLSASQVRTRLSRTATYLGSSFSYGRGLINVEAAAQ

SEQ ID NO: 203 - protein, 274 aa, B. subtilis
AQTVPYGIPLIKADKVQAQGYKGANVKVGIIDTGIAASHTDLKVVGGASFVSGESYNTDGNGHGTHVAGTVAALDNTTGVLGVAPNVSLYAIKVLNSSGSGTYSAIVSGIEWATQNGLDVINMSLGGPSGSTALKQAVDKAYASGIVVVAAAGNSGSSGSQNTIGYPAKYDSVIAVGAVDSNKNRASFSSVGAELEVMAPGVSVYSTYPSNTYTSLNGTSMASPHVAGAAALILSKYPTLSASQVRNRLSSTATNLGDSFYYGKGLINVEAAAQ

SEQ ID NO: 204 - protein, 274 aa, B. subtilis
AQTVPYGIPLIKADKVQAQGYKGANVKVGIIDTGIAASHTDLKVVGGASFVSGESYNTDGNGHGTHVAGTVAALDNTTGVLGVAPNVSLYIAKVLNSSGSGTYSAIVSGIEWATQNGLDVINMSLGGPSGSTALKQAVDKAYASGIVVVAAAGNSGSSGSQNTIGYPAKYDSVIAVGAVDSNKNRASFSSVGAELEVMAPGVSVYSTYPSNTYTSLNGTSMASPHVAGAAALILSKYPTLSASQVRNRLSSTATNLGDSFYYGKGLINVEAAAQ

SEQ ID NO: 205 - protein, 274 aa, B.licheniformis
AQTVPYGIPLIKADKVQAQGYKGANVKVGIIDTGIASSHTDLKVVGGASFVSGESYNTDGNGHGTHVAGTVAALDNTTGVLGVAPNVSLYAIKVLNSSGSGTYSAIVSGIEWATQNGLDVINMSLGGPSGSTALKQAVDKAYASGIVVVAAAGNSGSSGSQNTIGYPAKYDSVIAVGAVDSNKNRASFSSVGSELEVMAPGVSVYSTYPSNTYTSLNGTSMASPHVAGAAALILSKYPTLSASQVRNRLSSTATNLGDSFYYGKGLINVEAAAQ

SEQ ID NO: 206 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGTPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 207 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 208 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGTPSGSTAMKQAVDNAYARGVVVVAAAGNSGSSGNTNTIQYPAKYDSVIAVGAVDSNSQRASFSSVGAELEVMAPGAQVYSTYPTNTYATLSGTSMASPHVAGAAALILSKHPNLSASQVRNRLSSTATYLGSSFYYGKGLINVEAAAQ

SEQ ID NO: 209 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAQVYSTYPTNTYATLSGTSMASPHVAGAAALILSKHPNLSASQVRNRLSSTATYLGSSFYYGKGLINVEAAAQ

SEQ ID NO: 210 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 211 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 212 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAQVYSTYPTNTYATLSGTSMASPHVAGAAALILSKHPNLSASQVRNRLSSTATYLGPSFYYGKGLINVEAAAQ

SEQ ID NO: 213 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAQVYSTYPTNTYATLSGTSMASPHVAGAAALILSKHPNLSASQVRNRLSSTATYLGPSFYYGKGLINVEAAAQ

SEQ ID NO: 214 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPHVSLYAVKVLNSSGSGSYSGIVSGIEWATFNGMDVINMSLGTASGSTAMKQAVDNAYVRGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 215 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNTTGVLGVAPHVSLYAVKVLNSSGSGSYSGIVSGIEWATFNGMDVINISLGGASGSTAMKQAVDNAYVRGVVVVAAAGNSGSSGNTNTIQYPAKYDSVIAVGAVDSNSNRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 216 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPHGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 217 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPHGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 218 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVAGTVAALDNTTGVLGVAPHVSLYAVKVLNSSGSGSYSGIVSGIEWATFNGMDVINMSLGGAHGSTAMKQAVDNAYVRGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 219 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNTTGVLGVAPHVSLYAVKVLNSSGSGSYSGIVSGIEWATFNGMDVINISLGGAHGSTAMKQAVDNAYVRGVVVVAAAGNSGSSGNTNTIQYPAKYDSVIAVGAVDSNSNRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 220 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNNGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 221 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNNGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 222 - protein, 274 aa, artificial sequence
  AprL protease variant
AQTVPYGIPLIKADKVQAQGFKGANVKVAVLDTGAQASHPDLNVVGGASFVAGEAYNTDGNGHGTHVSGTVAALDNNTGVLGVAPSSSLYAVKVLNSSGSGSYSGIVSGIEWATTNGMDVINMSLGGPSGSTAMKQAVDNAYARGVLVVAAAGNSGSSGNTNTIQYPAKYDSVIAVGAVDSNSNRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 223 - protein, 274 aa, artificial sequence
  AprL protease variant
AQVVPYGIPLIKADKVQAQGFKGANVKVAVLDTGAQASHPDLNVVGGASFVAGEAYNTDGNGHGTHVSGTVAALDNNTGVLGVAPSSSLYAVKVLNSSGSGSYSGIVSGIEWATTNGMDVINISLGGPSGSTAMKQAVDNAYARGVLVVAAAGNSGSSGNTNTIQYPAKYDSVIAVGAVDSNSNRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 224 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKNAVDNAYARGVVVVAAAGNNGSSGNTNTIQYPAKYDSVIAVGAVDSNSQRASFSSVGAELEVMAPGAGVYSTYPTNTYATLSGTSMASPHVAGAAALILSKHPNLSNSQVRNRLSSTATYLGSSFYYGKGLINVEAAAQ

SEQ ID NO: 225 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKNAVDNAYARGVVVVAAAGNNGSSGNTNTIQYPAKYDSVIAVGAVDSNSQRASFSSVGAELEVMAPGAGVYSTYPTNTYATLSGTSMASPHVAGAAALILSKHPNLSNSQVRNRLSSTATYLGSSFYYGKGLINVEAAAQ

SEQ ID NO: 226 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTAAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 227 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTAAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 228 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRAPFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 229 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRAPFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 230 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGRSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 231 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGRSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 232 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPRGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGDSFYYGKGLINVEAAAQ

SEQ ID NO: 233 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPRGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGDSFYYGKGLINVEAAAQ

SEQ ID NO: 234 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGRSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGHGLINVEAAAQ

SEQ ID NO: 235 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGRSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGHGLINVEAAAQ

SEQ ID NO: 236 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGRSGSTAMKQAVDNAYARGVVVVAAAGNSGSSGNTNTIQYPAKYDSVIAVGAVDSNSQRASFSSVGAELEVMAPGAEVYSTYPTNTYATLNGTSMASPHVAGAAALILSKHPNLSASQVRNRLSSTATYLGDSFYYGKGLINVEAAAQ

SEQ ID NO: 237 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGRSGSTAMKQAVDNAYARGVVVVAAAGNSGSSGNTNTIQYPAKYDSVIAVGAVDSNSQRASFSSVGAELEVMAPGAEVYSTYPTNTYATLNGTSMASPHVAGAAALILSKHPNLSASQVRNRLSSTATYLGDSFYYGKGLINVEAAAQ

SEQ ID NO: 238 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGRSGSTAMKQAVDNAYARGVVVVAAAGNSGSSGNTNTIQYPAKYDSVIAVGAVDSNSERASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 239 - protein, 274 aa, artificial sequence
  AprL protease variant
AQVVPYGIPLIKADKVQAQGFKGANVKVAVLDTGIQASHPDLNVVGGASFVRGEAYNTDGNGHGTHVSGTVAALDNNTGVLGVAPSVSLYAVKVLNSSGSGSYSGIVSGIEWATTNGMDVINISLGGRSGSTAMKQAVDNAYARGVVVVAAAGNSGSSGNTNTIQYPAKYDSVIAVGAVDSNSERASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 240 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGNGSYSNIVSGIEWATTNGMQVINMSLGGPSGSTAMKQAVDNAYARGVVVVAAAGNSGSNGDQNTIAYPAKYDSVIAVGAVDSNSQRASFSSVGAELEVMAPGAGVYSTYPTNTYATLSGTSMASPHVAGAAALILSKHPNLSASQVRNRLSSTATYLGPSFYYGSGLINVEAAAQ

SEQ ID NO: 241 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGNGSYSNIVSGIEWATTNGMDVINMSLGGPSGSTAMKQAVDNAYARGVVVVAAAGNSGSDGNQNTIAYPAKYDSVIAVGAVDSNSQRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 242 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGNGSYSNIVSGIEWATTNGMDVINMSLGGPSGSTAMKQAVDNAYARGVVVVAAAGNSGSNGDQNTIAYPAKYDSVIAVGAVDSNSQRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 243 - protein, 274 aa, artificial sequence
  AprL protease variant
AQTVPYGIPLIKADKVQAQGFKGQNVKVAVLDTGIQASHPDLNVIGGASFVAGEAYNTDGNGHGTHVSGTVAALDNNTGVLGVAPSVSLYAVKVLNSRGSGSYSGIVSGIQWATTNGMDVINISLGGASGSTAMKQAVDNAYARGVVVVAAAGNSGSQGNTNTIEYPAKYDSVIAVGAVDSNSQRAEFSSVGAELEVMAPGAGIYSTYPINTYATLSGTSMASPHVAGAAALILSKHPNLSASQVRNRLSSTATYLGSEFYYGKGLINVEAAAQ

SEQ ID NO: 244 - protein, 274 aa, artificial sequence
  AprL protease variant
AQTVPYGIELIKADKVQAQGFKGANVKVAVLDTGIQASHPDLNVVGGASFVRGEAYNTDGNGHGTHVAGTVAALDNTTGVLGVAPRVSLYAVKVLNSSGSGSYSGIVSGIQWATTNGMDVINMSLGGARGSTAMKQAVDNAYARGVVVVAAAGNSGSQGNTNTIEYPAKYDSVIAVGAVDSNSNRASFSSVGAELEVMAPGAGIYSTYPINTYATLNGTSMASPHVAGAAALILSKHPNLSASQVRNRLSSTATYLGDEFYYGQGLINVEAAAQ

SEQ ID NO: 245 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGTPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 246 - protein, 274 aa, artificial sequence
  AprL protease variant
AQVVPYGIPLIKADKVQAQGFKGANVKVAVLDTGAQASHPDLNVVGGASFVAGEAYNTDGNGHGTHVAGTVAALDNNTGVLGVAPSSSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSGSQVRNRLSSTATYLGSSFYYGKGLINVEAAAQ

SEQ ID NO: 247 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGEPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 248 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGVPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 249 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAGAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 250 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGTPSGSTAMKQAVDNAYARGVVVVAGAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 251 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGGPSGSTAMKQAVDNAYARGVVVVAGAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 252 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVFNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 253 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVANSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 254 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVFNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 255 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSASGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 256 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSESGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 257 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSQSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 258 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSASGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 259 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVHGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 260 - protein, 274 aa, artificial sequence
  AprL protease variant
AQVVPYGIPLIKADKVQAQGFKGANVKVAVLDTGAQASHPDLNVVGGASFVAGEAYNTDGNGHGTHVAGTVAALDNNTGVLGVAPSSSLYAVKVLNSSGSGSYSGIVSGIEWATTNGMDVINISLGGPSGSTAMKQAVDNAYARGAVVVAAAGNSGSSGNTNTIQYPAKYDSVIAVGAVDSNSQRASFSSVGAELEVMAPGVGVYSTYPTNTYATLSGTSMASPHVAGAAALILSKHPNLSGSQVRNRLSSTATYLGSSFYYGKGLINVEAAAQ

SEQ ID NO: 261 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGTPSGSTAMKQAVDNAYARGVVVVAAAGNSGSSGNTNTIEYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 262 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGAVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 263 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNDNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 264 - protein, 274 aa, artificial sequence
  AprL protease variant
AQVVPYGIPLIKADKVQAQGFKGANVKVAVLDTGIQASHPDLNVRGGASFVAGEAYNTDGNGHGTHVSGTVAALDNNTGVLGVAPSVSLYAVKVLNSSGSGDYSGIVSGIEWATTNGMDVINMSLGGPSGSTAMKQAVDNAYARGVVVVAAAGNSGSSGNDNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 265 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGTPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 266 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGTPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 267 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGVPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 268 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 269 - protein, 274 aa, artificial sequence
  AprL protease variant
AQVVPYGIPLIKADKVQAQGFKGANVKVAVLDTGAQASHPDLNVVGGASFVAGEAYNTDGNGHGTHVAGTVAALDNNTGVLGVAPSSSLYAVKVLNSSGSGSYSGIVSGIEWATTNGMDVINMSLGTPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSGSQVRNRLSSTATYLGPSFYYGKGLINVEAAAQ

SEQ ID NO: 270 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGQPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 271 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGVPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 272 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVAGTVAALDNNTGVLGVAPSVSLYAVKVLNSSGSGSYSGIVSGIEWATTNGMDVINISLGEPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 273 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGTPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 274 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGTPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGSSFYYGKGLINVEAAAQ

SEQ ID NO: 275 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 276 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGTPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 277 - protein, 274 aa, artificial sequence
  AprL protease variant
AQTVPYGIPMIKADKVQAQGFKGANVKVAVLDTGAQASHPDLNVVGGASFVAGEAYNTDGNGHGTHVAGTVAALDNTIGVLGVAPSSSLYAVKVLNSSGSGSYSGIVSGIEWATTNGMDVINISLGGASGSTAMKQAVDNAYARGVVVVAAAGNSGSSGNTNTIGYPAKYDSVIAVGAVDSNSNRASFSSVGAELEVMAPGVGVYSTYPTNTYATLNGTSMASPHVAGAAALILSKHPNLSASQVRNRLSSTATYLGDSWYYGKGLINVEAAAQ

SEQ ID NO: 278 - protein, 274 aa, artificial sequence
  AprL protease variant
AQTVPYGIPMIKADKVQAQGFKGANVKVAVLDTGAQASHPDLNVVGGASFVAGEAYNTDGNGHGTHVAGTVAALDNTIGVLGVAPSSSLYAVKVLNSSGSGSYSGIVSGIEWATTNGMDVINISLGGASGSTAMKQAVDNAYARGVVVVAAAGNSGSSGNTNTIGYPAKYDSVIAVGAVDSNSNRASFSSVGAELEVMAPGVGVYSTYPTNTYATLNGTSMASPHVAGAAALILSKHPNLSASQVRNRLSSTATYLGSSWYYGHGLINVEAAAQ

SEQ ID NO: 279 - protein, 274 aa, artificial sequence
  AprL protease variant
AQTVPYGIPMIKADKVQAQGFKGANVKVAVLDTGAQASHPDLNVVGGASFVAGEAYNTDGNGHGTHVAGTVAALDNTIGVLGVAPSSSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGVGVYSTYPTNTYATLNGTSMASPHVAGAAALILSKHPNLSASQVRNRLSSTATYLGDSFYYGKGLINVEAAAQ

SEQ ID NO: 280 - protein, 274 aa, artificial sequence
  AprL protease variant
AQTVPYGIPMIKADKVQAQGFKGANVKVAVLDTGAQASHPDLNVVGGASFVAGEAYNTDGNGHGTHVAGTVAALDNTIGVLGVAPSSSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRAEFSSVGAELEVMAPGVGVYSTYPTNTYATLNGTSMASPHVAGAAALILSKHPNLSASQVRNRLSSTATYLGSSFYYGKGLINVEAAAQ

SEQ ID NO: 281 - protein, 274 aa, artificial sequence
  AprL protease variant
AQTVPYGIPMIKADKVQAQGFKGANVKVAVLDTGIQASHPDLNVVGGASFVAGEAYNTDGNGHGTHVAGTVAALDNTIGVLGVAPSSSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRAEFSSVGAELEVMAPGVGVYSTYPTNTYATLNGTSMASPHVAGAAALILSKHPNLSASQVRNRLSSTATYLGSSFYYGKGLINVEAAAQ

SEQ ID NO: 282 - protein, 274 aa, artificial sequence
  AprL protease variant
AQTVPYGIPMIKADKVQAQGFKGANVKVAVLDTGAQASHPDLNVVGGASFVAGEAYNTDGNGHGTHVAGTVAALDNTIGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRAEFSSVGAELEVMAPGVGVYSTYPTNTYATLNGTSMASPHVAGAAALILSKHPNLSASQVRNRLSSTATYLGSSFYYGKGLINVEAAAQ

SEQ ID NO: 283 - protein, 274 aa, artificial sequence
  AprL protease variant
AQVVPYGIPMIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 284 - protein, 274 aa, artificial sequence
  AprL protease variant
AQVVPYGIPLIKADKVQAQGFKGANVKVAVLDTGAQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 285 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 286 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSSSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 287 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIEYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 288 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 289 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATQSGTSMASPHVAGAAALILSKHPNLSASQVRNRLSSTATYLGPSFYYGKGLINVEAAAQ

SEQ ID NO: 290 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSGSQVRNRLSSTATYLGPSFYYGKGLINVEAAAQ

SEQ ID NO: 291 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 292 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSWYYGKGLINVEAAAQ

SEQ ID NO: 293 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 294 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 295 - protein, 274 aa, artificial sequence
  AprL protease variant
AQVVPYGIPLIKADKVQAQGFKGANVKVAVIDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 296 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 297 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 298 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGTPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 299 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 300 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 301 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 302 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 303 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 304 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 305 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 306 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGDSFYYGKGLINVEAAAQ

SEQ ID NO: 307 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVHGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 308 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSQSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 309 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSQSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 310 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIEYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 311 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 312 - protein, 274 aa, artificial sequence
  AprL protease variant
AQVVPYGIELIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 313 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRAEFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 314 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVEVYSTYPPNTYATLSGTSMASPHVAGAAALILSKHPNLSASQVRNRLSSTATYLGPSFYYGKGLINVEAAAQ

SEQ ID NO: 315 - protein, 274 aa, artificial sequence
  AprL protease variant
AQVVPYGIPMIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 316 - protein, 274 aa, artificial sequence
  AprL protease variant
AQVVPYGIELIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 317 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRAEFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 318 - protein, 274 aa, artificial sequence
  AprL protease variant
AQVVPYGIELIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 319 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRAEFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 320 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVEVYSTYPPNTYATLSGTSMASPHVAGAAALILSKHPNLSASQVRNRLSSTATYLGPSFYYGKGLINVEAAAQ

SEQ ID NO: 321 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSASYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 322 - protein, 274 aa, artificial sequence
  AprL protease variant
AQVVPYGIPMIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 323 - protein, 274 aa, artificial sequence
  AprL protease variant
AQVVPYGIELIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 324 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRAEFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 325 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGVEVYSTYPPNTYATLSGTSMASPHVAGAAALILSKHPNLSASQVRNRLSSTATYLGPSFYYGKGLINVEAAAQ

SEQ ID NO: 326 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSASYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 327 - protein, 274 aa, artificial sequence
  AprL protease variant
AQVVPYGIPMIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 328 - protein, 274 aa, artificial sequence
  AprL protease variant
AQVVPYGIPMIKADKVQAQGFKGANVKVAVLDTGIQASHPDLNVVGGASFVAGEAYNTDGNGHGTHVSGTVAALDNNTGVLGVAPSVSLYAVKVLNSSGSASYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 329 - protein, 274 aa, artificial sequence
  AprL protease variant
AQVVPYGIEMIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 330 - protein, 274 aa, artificial sequence
  AprL protease variant
AQVVPYGIELIKADKVQAQGFKGANVKVAVLDTGIQASHPDLNVVGGASFVAGEAYNTDGNGHGTHVSGTVAALDNNTGVLGVAPSVSLYAVKVLNSSQSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 331 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSAIQVRNRLSSTATYLGPSFYYGKGLINVEAAAQ

SEQ ID NO: 332 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNTTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 333 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIGYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 334 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSNRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 335 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLNGTSMASPHVAGAAALILSKHPNLSASQVRNRLSSTATYLGPSFYYGKGLINVEAAAQ

SEQ ID NO: 336 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNETGVLGVAPSVSLYAVKVLNSSGSGSYSGIVSGIEWATTNGMDVINISLGTPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 337 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNETGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 338 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGHGLINVEAAAQ

SEQ ID NO: 339 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGTYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTSTYATLSGTSMASPHVAGAAALILSKHPNLSASQVRNRLSSTATYLGPSFYYGKGLINVEAAAQ

SEQ ID NO: 340 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTSTYATLSGTSMASPHVAGAAALILSKHPNLSASQVRNRLSSTATYLGPSFYYGKGLINVEAAAQ

SEQ ID NO: 341 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGTYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 342 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPPFYYGKGLINVEAAAQ

SEQ ID NO: 343 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNQNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 344 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSQGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 345 - protein, 274 aa, artificial sequence
  AprL protease variant
AQVVPYGIPLIKADKVQAQGFKGANVKVAVLDTGIQASHPDLNVQGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 346 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGQELEVMAPGVGVYSTYPTNTYATLSGTSMASPHVAGAAALILSKHPNLSASQVRNRLSSTATYLGPSFYYGKGLINVEAAAQ

SEQ ID NO: 347 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYQRGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 348 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNSMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 349 - protein, 274 aa, artificial sequence
  AprL protease variant
AQVVPYGIPLIKADKVQAQGFKGANVKVAVLDTGIQASHPDLNVVGGVSFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 350 - protein, 274 aa, artificial sequence
  AprL protease variant
AQVVPYGIPLIKADKVQAQGFKGANVKVAVLDTGIQASHPDLNVVGGTSFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 351 - protein, 274 aa, artificial sequence
  AprL protease variant
AQVVPYGIPLIKADKVQAQGFKGANVKVSVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 352 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 353 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 354 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 355 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 356 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 357 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSQSGSYSGIVSGIEWATTNGMDVINMSLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 358 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSSSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 359 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSGSQVRNRLSSTATYLGPSFYYGKGLINVEAAAQ

SEQ ID NO: 360 - protein, 274 aa, artificial sequence
  AprL protease variant
AQVVPYGIPLIKADKVQAQGFKGANQKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIEYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 361 - protein, 274 aa, artificial sequence
  AprL protease variant
AQVVPYGIEMIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIEYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 362 - protein, 274 aa, artificial sequence
  AprL protease variant
AQVVPYGIEMIKADKVQAQGFKGANVKVAVLDTGIQASHPDLNVVGGASFVAGEAYNTDGNGHGTHVSGTVAALDNNTGVLGVAPSVSLYAVKVLNSSGSASYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 363 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 364 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSGSGSYSGIVSGIEWATTNGMDVINISLGSPSGSTAMKQAVDNAYARGVVVVAAAGNSGSSGKTNTIQYPAKYDSVIAVGAVDSNSQRASFSSVGAELEVMAPGVGVYSTYPPNTYATLSGTSMASPHVAGAAALILSKHPNLSGSQVRNRLSSTATYLGPSFYYGKGLINVEAAAQ

SEQ ID NO: 365 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSSSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSASQVRNRLSSTATYLGPSFYYGKGLINVEAAAQ

SEQ ID NO: 366 - protein, 274 aa, artificial sequence
  AprL protease variant
AQVVPYGIPLIKADKVQAQGFKGANVKVAVLDTGIQASHEDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 367 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNETGVLGVAPSVSLYAVKVLNSSGSGSYSGIVSGIEWATTNGMDVINISLGTPSGSTAMKQAVDNAYARGVVVVAAAGNSGSSGNTNTIEYPAKYDSVIAVGAVDSNSQRASFSSVGAELEVMAPGVGVYSTYPTNTYATLSGTSMASPHVAGAAALILSKHQNLSASQVRNRLSSTATYLGPSFYYGKGLINVEAAAQ

SEQ ID NO: 368 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSSSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 369 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNETGVLGVAPSVSLYAVKVLNSSGSGSYSGIVSGIEWATTNGMDVINISLGTASGSTAMKQAVDNAYARGVVVVAAAGNSGSSGNTNTIEYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 370 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGPSFYYGKGLINVEAAAQ

SEQ ID NO: 371 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSATYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSFYYGKGLINVEAAAQ

SEQ ID NO: 372 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 373 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSSSGSYSGIVSGIEWATTNGMDVINMSLGSPSGSTAMKQAVDNAYARGVVVVAAAGNSGSSGNTNTIQYPAKYDSVIAVGAVDSNSNRASFSSVGAELEVMAPGAGVYSTYPPNTYATLNGTSMASPHVAGAAALILSKHPNLSGSQVRNRLSSTATYLGPSFYYGHGLINVEAAAQ

SEQ ID NO: 374 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSSSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSGSQVRNRLSSTATYLGPSFYYGKGLINVEAAAQ

SEQ ID NO: 375 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINISLGTASGSTAMKQAVDNAYARGVVVVAAAGNSGSSGNTNTIEYPAKYDSVIAVGAVDSNSQRASFSSVGAELEVMAPGVGVYSTYPTNTYATLSGTSMASPHVAGAAALILSKHQNLSASQVRNRLSSTATYLGPSFYYGKGLINVEAAAQ

SEQ ID NO: 376 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSSSGSYSGIVSGIEWATTNGMDVINMSLGSPSGSTAMKQAVDNAYARGVVVVAAAGNSGSSGNTNTIQYPAKYDSVIAVGAVDSNSNRASFSSVGAELEVMAPGAGVYSTYPPNTYATLNGTSMASPHVAGAAALILSKHPNLSGSQVRNRLSSTATYLGPSFYYGKGLINVEAAAQ

SEQ ID NO: 377 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSSSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSGSQVRNRLSSTATYLGDSFYYGKGLINVEAAAQ

SEQ ID NO: 378 - protein, 274 aa, artificial sequence
  AprL protease variant
AQTVPYGIPLIKADKVQAQGFKGANVKVAVLDTGAQASHPDLNVVGGASFVAGEAYNTDGNGHGTHVAGTVAALDNTTGVLGVAPSVSLYAVKVLNSSGSGSYSGIVSGIEWATTNGMDVINISLGTASGSTAMKQAVDNAYARGVVVVAAAGNSGSSGNTNTIGYPAKYDSVIAVGAVDSNSNRASFSSVGAELEVMAPGAGVYSTYPPNTYATLNGTSMASPHVAGAAALILSKHPNLSAIQVRNRLSSTATYLGSSFYYGKGLINVEAAAQ

SEQ ID NO: 379 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSSSGSYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGPSWYYGKGLINVEAAAQ

SEQ ID NO: 380 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSSSASYSGIVSGIEWATTNGMDVINMSLGSPSGSTAMKQAVDNAYARGVVVVAAAGNSGSSGNTNTIQYPAKYDSVIAVGAVDSNSNRASFSSVGAELEVMAPGAGVYSTYPPNTYATLNGTSMASPHVAGAAALILSKHPNLSGSQVRNRLSSTATYLGPSFYYGKGLINVEAAAQ

SEQ ID NO: 381 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSQSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGSSFYYGKGLINVEAAAQ

SEQ ID NO: 382 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGVGVYSTYPTNTYATLSGTSMASPHVAGAAALILSKHPNLSASQVRNRLSSTATYLGSSFYYGKGLINVEAAAQ

SEQ ID NO: 383 - protein, 274 aa, artificial sequence
  AprL protease variant
AQTVPYGIPLIKADKVQAQGFKGANVKVAVLDTGIQASHPDLNVVGGASFVAGEAYNTDGNGHGTHVSGTVAALDNNTGVLGVAPSVSLYAVKVLNSSGSGSYSGIVSGIEWATTNGMDVINMSLGGPSGSTAMKQAVDNAYARGVVVVAAAGNSGSSGNTNTIQYPAKYDSVIAVGAVDSNSQRASFSSVGAELEVMAPGAGVYSTYPTNTYATLSGTSMASPHVAGAAALILSKHPNLSASQVRNRLSSTATYLGDSFYYGKGLINVEAAAQ

SEQ ID NO: 384 - protein, 274 aa, artificial sequence
  AprL protease variant
AQVVPYGIPLIKADKVQAQGFKGANVKVAVLDTGIQASHPDLNVVGGASFVAGEAYNTDGNGHGTHVSGTVAALDNNIGVLGVAPSVSLYAVKVLNSSSSASYSGIVSGIEWATTNGMDVINISLGSPSGSTAMKQAVDNAYARGVVVVAAAGNSGSSGNTNTIQYPAKYDSVIAVGAVDSNSQRASFSSVGAELEVMAPGVGVYSTYPPNTYATLSGTSMASPHVAGAAALILSKHPNLSGSQVRNRLSSTATYLGPSFYYGKGLINVEAAAQ

SEQ ID NO: 385 - protein, 274 aa, artificial sequence
  AprL protease variant
AQTVPYGIPLIKADKVQAQGFKGANVKVAVLDTGIQASHPDLNVRGGASFVAGEAYNTDGNGHGTHVAGTVAALDNTTGVLGVAPSVSLYAVKVLNSRGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMASPHVAGAAALILSKHPNLSASQVRNRLSSTATYLGSSFYYGKGLINVEAAAQ

We claim:

1. A subtilisin variant comprising an amino acidsequence comprising one or more amino acid substitution sets selected from G165Q-A202V, N217S-S258P, G165Q-S258P, T78I-N217S, and T78I-S258P, wherein said variant has at least 85% amino acid sequence identity to the amino acid sequence of SEQ ID NO: 2; wherein the amino acid positions of the variant are numbered by correspondence with the aminoacid sequence of SEQ ID NO:2, and wherein the variant has protease activity measured by hydrolysis of N-succinyl-alanine-alanine-proline-phenylalanine-p-nitroanilide (N-suc-AAPF-pNA) or dimethyl casein substrate.

2. The subtilisin variant of claim 1, wherein said variant further comprises an amino acid sequence comprising one or more substitution sets selected from: G165Q-N217S-S258P, G127F-G165Q-N217S-S258P; T77N-G165Q-N217S-S258P, and T77N-G165Q-N217S.

3. The isolated subtilisin variant of claim 1, wherein said variant comprises an amino acid sequence having at least 90% amino acid sequence identity to the amino acid sequence of SEQ ID NO: 2.

4. The subtilisin variant of claim 1, wherein said variant is from a parent comprising the amino acid sequence of SEQ ID NO:2.

5. The subtilisin variant of claim 1, wherein said variant has one or more improved property when compared to a reference subtilisin; wherein the improved property is selected from improved protease activity, improved cleaning performance in detergent, improved thermostability in detergent, and improved aged laundry cleaning in detergent.

6. The subtilisin variant of claim 5, wherein the improved property is
 (i) improved protease activity, wherein said variant has a performance index (PI) >1 on N-succinyl-alanine-alanine-proline-phenylalanine-p-nitroanilide (N-suc-AAPF-pNA) or dimethyl casein substrate;
 (ii) improved cleaning performance in detergent, wherein said variant has a blood/milk/ink (BMI), pigment/oil/milk (POM), egg, or egg yolk cleaning PI >1;
 (iii) improved thermostability in detergent, wherein said variant has a stability PI >1 or % remaining activity ≥5%, after 15-20 minutes at a stress temperature of 60° C.; or
 (iii)improved aged laundry cleaning in detergent, wherein said variant has (a) an aged laundry cleaning PI >1, (b) remaining cleaning activity >10%, or more after 24 hours at 55° C., and/or (c) remaining cleaning activity >10%, after 3 days or 3 weeks at 37° C.

7. A composition comprising one or more subtilisin variant of claim 1.

8. The composition of claim 7, wherein said composition is a detergent composition.

9. The composition of claim 8, wherein the detergent composition is selected from a laundry detergent, a fabric softening detergent, a dishwashing detergent, and a hard-surface cleaning detergent.

10. The composition of claim 7, wherein said composition further comprises one or more calcium ion or zinc ion; one or more enzyme stabilizer; from about 0.001% to about 1.0 weight % of said subtilisin variant; one or more bleaching agent; one or more adjunct material; or one or more additional enzymes selected from the group consisting of acyl transferases, alpha-amylases, beta-amylases, alpha-galactosidases, arabinosidases, aryl esterases, beta-galactosidases, carrageenases, catalases, cellobiohydrolases, cellulases, chondroitinases, cutinases, DNase or nuclease, endo-beta-1,4-glucanases, endo-beta-mannanases, esterases, exo-mannanases, galactanases, glucoamylases, hemicellulases, hyaluronidases, keratinases, laccases, lactases, ligninases, lipases, lipoxygenases, lysozymes, mannanases, oxidases, pectate lyases, pectin acetyl esterases, pectinases, pentosanases, peroxidases, phenoloxidases, phosphatases, phospholipases, phytases, polygalacturonases, proteases, pullulanases, reductases, rhamnogalacturonases, beta-glucanases, tannases, transglutaminases, xylan acetyl-esterases, xylanases, xyloglucanases, xylosidases, metalloproteases, additional serine proteases, and combinations thereof.

11. The composition of claim 7, wherein said composition contains phosphate or contains boron.

12. The composition of claim 7, wherein said composition is a granular, powder, solid, bar, liquid, tablet, gel, paste or unit dose composition.

13. A method of cleaning, comprising contacting a surface or an item in need of cleaning with the composition of claim 7.

14. The method of claim 13, wherein the method further comprises a step of rinsing said surface or item after contacting said surface or item with said variant or composition.

15. The method of claim 13, wherein said item in need of cleaning is dishware or fabric.

\* \* \* \* \*